(12) United States Patent
Asami et al.

(10) Patent No.: US 10,435,445 B2
(45) Date of Patent: Oct. 8, 2019

(54) PEPTIDE COMPOUND

(71) Applicant: Takeda Pharmaceutical Company Limited, Chuo-ku, Osaka-shi, Osaka (JP)

(72) Inventors: Taiji Asami, Kanagawa (JP); Naoki Nishizawa, Kanagawa (JP); Ayumu Niida, Kanagawa (JP); Yoko Kanematsu, Kanagawa (JP); Mari Adachi, Kanagawa (JP); Shiro Takekawa, Kanagawa (JP); Tomoko Morimoto, Kanagawa (JP)

(73) Assignee: TAKEDA PHARMACEUTICAL COMPANY LIMITED, Osaka (JP)

( * ) Notice: Subject to any disclaimer, the term of this patent is extended or adjusted under 35 U.S.C. 154(b) by 0 days.

(21) Appl. No.: 15/941,030

(22) Filed: Mar. 30, 2018

(65) Prior Publication Data

US 2018/0298070 A1    Oct. 18, 2018

(30) Foreign Application Priority Data

Mar. 31, 2017 (JP) ................. 2017-072556

(51) Int. Cl.
| | | |
|---|---|---|
| A61K 38/00 | (2006.01) | |
| C07K 14/47 | (2006.01) | |
| C07K 14/605 | (2006.01) | |
| A61K 47/60 | (2017.01) | |
| A61P 1/08 | (2006.01) | |

(52) U.S. Cl.
CPC .......... *C07K 14/4705* (2013.01); *A61K 47/60* (2017.08); *A61P 1/08* (2018.01); *C07K 14/605* (2013.01); *A61K 38/00* (2013.01)

(58) Field of Classification Search
None
See application file for complete search history.

(56) References Cited

U.S. PATENT DOCUMENTS

| 2011/0136737 A1 | 6/2011 | Levy et al. |
| 2016/0015788 A1 | 1/2016 | Holscher |

FOREIGN PATENT DOCUMENTS

| EP | 0479210 A2 | 4/1992 |
| WO | WO 00/69911 A1 | 11/2000 |
| WO | WO 03/082898 A2 | 10/2003 |
| WO | WO 2005/082928 A2 | 9/2005 |
| WO | WO 2006/086769 A2 | 8/2006 |
| WO | WO 2006/121904 A1 | 11/2006 |
| WO | WO 2007/028632 A2 | 3/2007 |
| WO | WO 2007/028633 A2 | 3/2007 |
| WO | WO 2007/109354 A2 | 9/2007 |
| WO | WO 2008/021560 A2 | 2/2008 |
| WO | WO 2009/042922 A2 | 4/2009 |
| WO | WO 2010/011439 A2 | 1/2010 |
| WO | WO 2010/016935 A2 | 2/2010 |
| WO | WO 2010/016938 A2 | 2/2010 |
| WO | WO 2010/016940 A2 | 2/2010 |
| WO | WO 2010/016944 A2 | 2/2010 |
| WO | WO 2010/071807 A1 | 6/2010 |
| WO | WO 2010/148089 A1 | 12/2010 |
| WO | WO 2011/014680 A2 | 2/2011 |
| WO | WO 2011/094337 A1 | 8/2011 |
| WO | WO 2011/119657 A1 | 9/2011 |
| WO | WO 2012/055770 A1 | 5/2012 |
| WO | WO 2012/088116 A2 | 6/2012 |
| WO | WO 2012/088379 A2 | 6/2012 |
| WO | WO 2012/167744 A1 | 12/2012 |
| WO | WO 2013/003449 A2 | 1/2013 |
| WO | WO 2013/164483 A1 | 11/2013 |
| WO | WO 2013/192129 A1 | 12/2013 |
| WO | WO 2013/192130 A1 | 12/2013 |
| WO | WO 2014/096145 A1 | 6/2014 |
| WO | WO 2014/096148 A1 | 6/2014 |
| WO | WO 2014/096149 A1 | 6/2014 |
| WO | WO 2014/096150 A1 | 6/2014 |
| WO | WO 2014/192284 A1 | 12/2014 |
| WO | WO 2015/022420 A1 | 2/2015 |
| WO | WO 2015/067715 A2 | 5/2015 |
| WO | WO 2015/067716 A1 | 5/2015 |
| WO | WO 2015/086728 A1 | 6/2015 |
| WO | WO 2015/086729 A1 | 6/2015 |
| WO | WO 2015/086730 A1 | 6/2015 |
| WO | WO 2016/034186 A1 | 3/2016 |
| WO | WO 2016/066744 A2 | 5/2016 |

(Continued)

OTHER PUBLICATIONS

Finan et al., Unimolecular Dual Incretins Maximize Metabolic Benefits in Rodents, Monkeys, and Humans, Sci. Trans. Med., Oct. 3, 2013, 5(209):209ra151, 1-17, with Supplemental Material, 8 pages.

(Continued)

*Primary Examiner* — Jeanette M Lieb
(74) *Attorney, Agent, or Firm* — Honigman LLP; Fernando Alberdi; Jonathan P. O'Brien

(57) ABSTRACT

The present invention provides a novel peptide compound having an activating action on GIP receptors and use of the peptide compound as a medicament.

Specifically, a peptide containing a sequence represented by the formula (I) or a salt thereof and a medicament comprising the same are provided.

(I)
$P^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-$P^2$ wherein each symbol is as defined herein.

41 Claims, 28 Drawing Sheets
Specification includes a Sequence Listing.

(56) References Cited

FOREIGN PATENT DOCUMENTS

| WO | WO 2016/077220 A1 | 5/2016 |
|----|-------------------|--------|
| WO | WO 2016/084826 A1 | 6/2016 |
| WO | WO 2016/111971 A1 | 7/2016 |
| WO | WO 2016/198624 A1 | 12/2016 |
| WO | WO 2017/075505 A2 | 5/2017 |
| WO | WO 2017/116204 A1 | 7/2017 |
| WO | WO 2017/204219 A1 | 11/2017 |

OTHER PUBLICATIONS

Hackethal, Veronica, "Drugs with dual-hormone action gain attention in diabetes field," Nature Medicine, Dec. 2013, 19(12):1549-1550.

Al-Sabah and Donnelly, "A model for receptor-peptide binding at the glucagon-like peptide-1 (GLP-1) receptor through the analysis of truncated ligands and receptors", British Journal of Pharmacology, 140(2):339-346, 2003.

Runge, et al., "Differential Structural Properties of GLP-1 and Exendin-4 Determine Their Relative Affinity for the GLP-1 Receptor N-Terminal Extracellular Domain", Biochemistry, 46(19):5830-5840, 2007.

[Fig. 3]
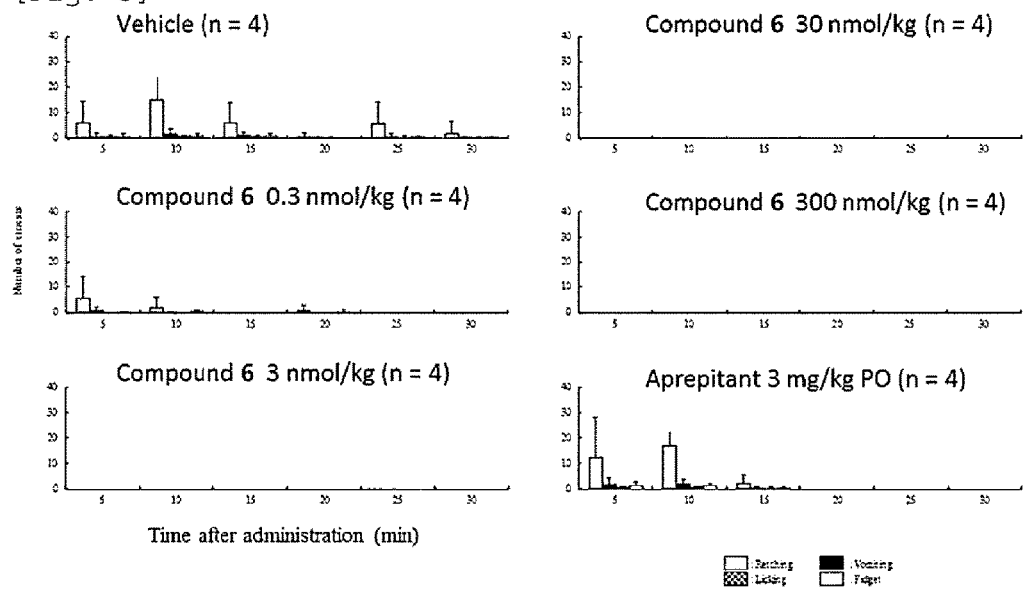
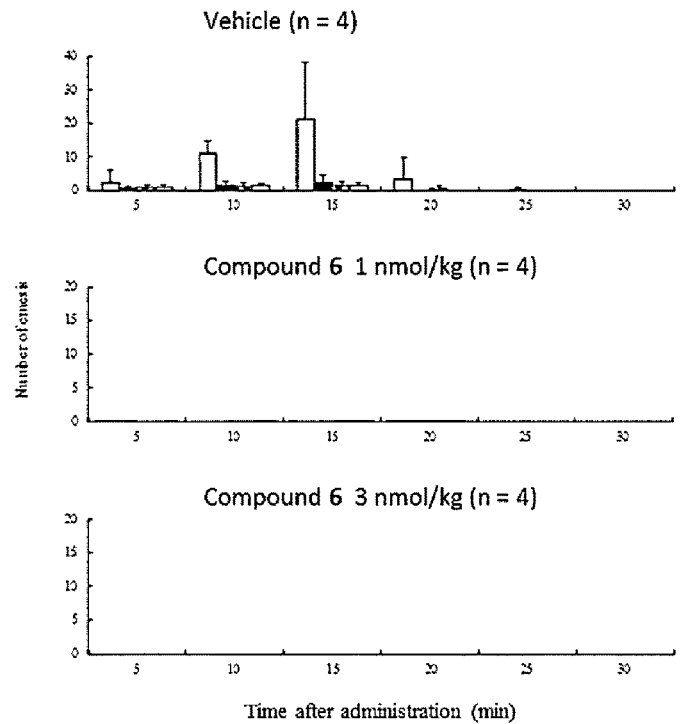

[Fig. 4]
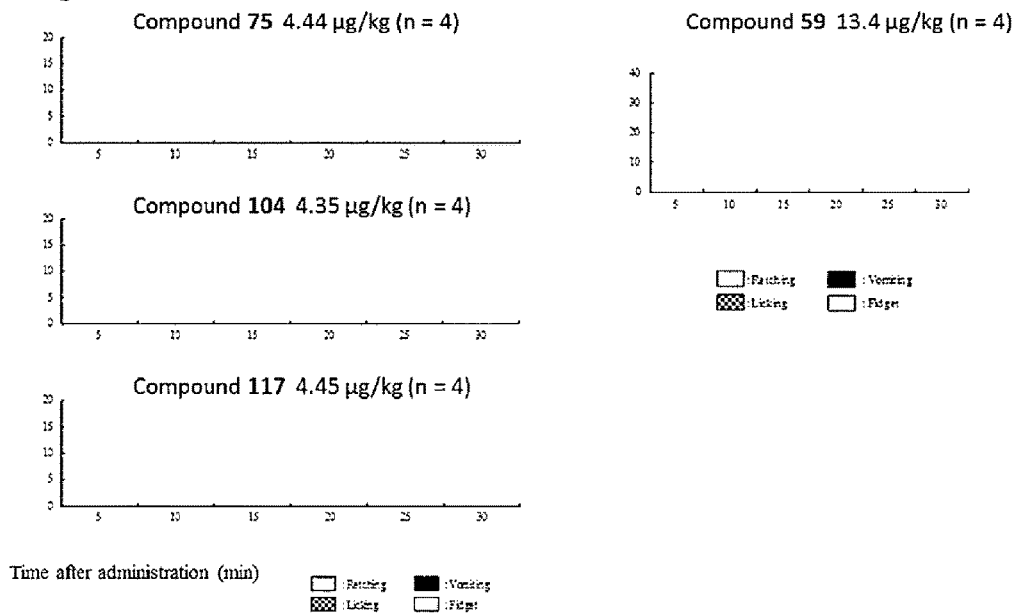
[Fig. 5]
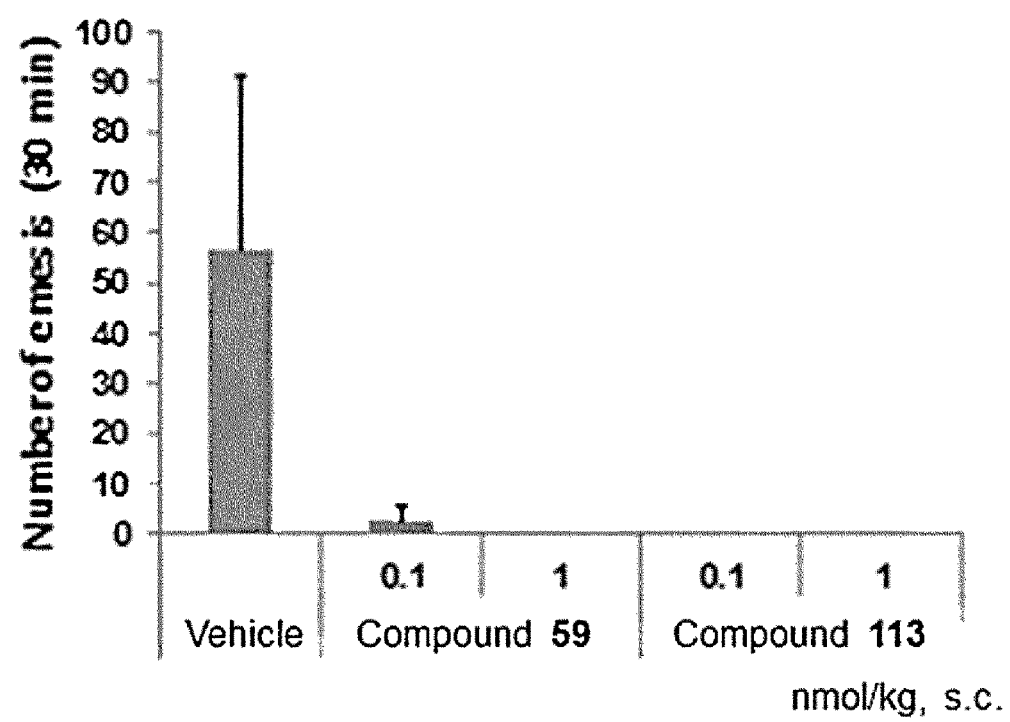

FIG. 6B
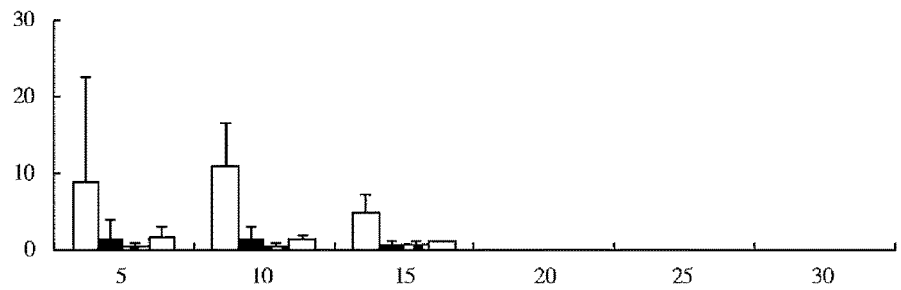
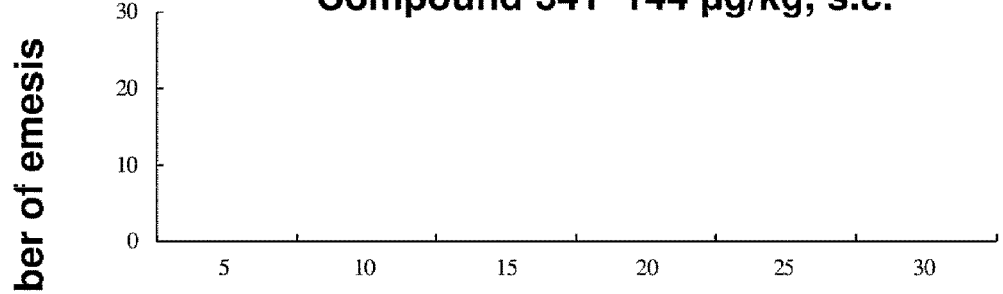
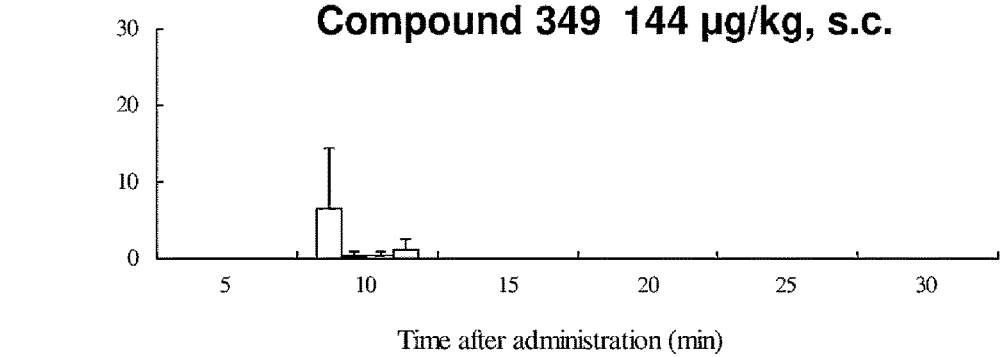

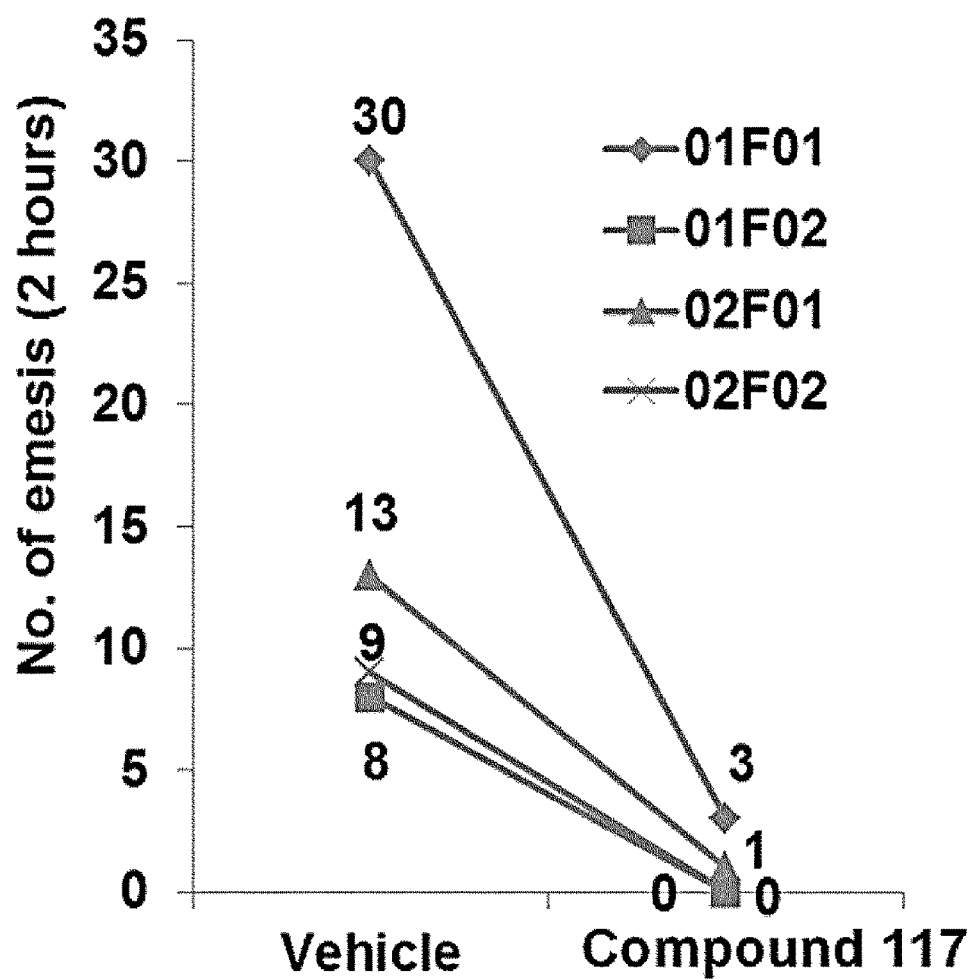

| Compound | N | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 | 38 | 39 | 40 | | SEQ ID NO |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| | | | | | | | | | | | | | | | | | | | | | | | | | | | | | | | | | | | | | | | | | | | Amino acid |
| 83 | Me | Y | Aib | E | G | T | F | - | S | D | Y | S | - | D-Iva | L | D | R | - | A | Q | Aib | N | F | V | N | W | L | L | A | Q | R | P | S | G | A | P | P | P | S | R | NH2 | 89 |
| 84 | Me | Y | Aib | E | T | T | F | - | S | D | Y | S | - | A | L | D | R | Aib | A | Q | Aib | N | F | V | N | W | Iva | L | A | Q | R | P | S | G | A | P | P | P | S | R | NH2 | 90 |
| 85 | Me | Y | Aib | E | G | T | F | - | S | D | Y | S | - | D-Iva | L | D | R | Aib | A | Q | Aib | N | F | V | N | W | Iva | L | A | Q | R | P | S | G | A | P | P | P | S | R | NH2 | 91 |
| 86 | Me | Y | Aib | E | G | T | Iva | - | S | D | Y | S | - | D-Iva | L | D | R | Aib | A | Q | Q | D | αMeF | V | N | W | Iva | L | A | Q | R | P | S | G | A | P | P | P | S | R | NH2 | 92 |
| 87 | Me | Y | Aib | E | G | T | Iva | - | S | D | Y | S | - | D-Iva | L | D | R | Aib | A | Q | Aib | N | F | V | N | W | Iva | L | A | Q | R | P | S | G | A | P | P | P | S | R | NH2 | 93 |
| 88 | Me | Y | Aib | E | G | T | Iva | - | S | D | Y | S | - | A | L | D | R | - | A | Q | Q | D | αMeF | V | N | W | L | L | A | Q | R | P | S | G | A | P | P | P | S | R | NH2 | 94 |
| 89 | Me | Y | Aib | E | G | T | Iva | - | S | D | Y | S | - | A | L | D | R | Aib | A | Q | Aib | D | F | V | N | W | L | L | A | Q | R | P | S | G | A | P | P | P | S | R | NH2 | 95 |
| 90 | Me | Y | Aib | E | G | T | Iva | - | S | D | Y | S | - | A | L | D | R | - | A | Q | Q | D | F | V | N | W | Iva | L | A | Q | R | P | S | G | A | P | P | P | S | R | NH2 | 96 |
| 91 | Me | Y | Aib | E | G | T | F | - | S | D | Y | S | - | A | L | D | R | - | A | Q | Aib | D | F | V | N | W | L | L | A | Q | R | P | S | G | A | P | P | P | S | R | NH2 | 97 |
| 92 | Me | Y | Aib | E | G | T | F | - | S | D | Y | S | - | D-Iva | L | D | R | - | A | Q | Q | N | F | V | N | W | Iva | L | A | Q | R | P | S | G | A | P | P | P | S | R | NH2 | 98 |
| 93 | Me | Y | Aib | E | G | T | F | - | S | D | Y | S | - | D-Iva | L | D | R | - | A | Q | Q | D | F | V | N | W | Iva | L | A | Q | R | P | S | G | A | P | P | P | S | R | NH2 | 99 |
| 94 | Me | Y | Aib | E | G | T | Iva | - | S | D | Y | S | - | D-Iva | L | D | R | - | A | Q | Q | D | F | V | N | W | Iva | L | A | Q | R | P | S | G | A | P | P | P | S | R | NH2 | 100 |
| 95 | Me | Y | Aib | E | G | T | F | - | S | D | Y | S | - | A | L | D | R | Aib | A | Q | Aib | D | αMeF | V | N | W | L | L | A | Q | R | P | S | G | A | P | P | P | S | R | NH2 | 101 |
| 96 | Me | Y | Aib | E | G | T | F | - | S | D | Y | S | - | A | L | D | R | - | A | Q | Q | D | F | V | N | W | Iva | L | A | Q | R | P | S | G | A | P | P | P | S | R | NH2 | 102 |
| 97 | Me | Y | Aib | E | G | T | Iva | - | S | D | Y | S | - | A | L | D | R | - | A | Q | Aib | N | F | V | N | W | L | L | A | Q | R | P | S | G | A | P | P | P | S | R | NH2 | 103 |
| 98 | Me | Y | Aib | E | G | T | F | - | S | D | Y | S | - | A | L | D | R | Aib | A | Q | Aib | D | αMeF | V | N | W | Iva | L | A | Q | R | P | S | G | A | P | P | P | S | R | NH2 | 104 |
| 99 | Me | Y | Aib | E | G | T | F | - | S | D | Y | S | - | D-Iva | L | D | R | Aib | A | Q | Q | D | αMeF | V | N | W | L | L | A | Q | R | P | S | G | A | P | P | P | S | R | NH2 | 105 |
| 100 | Me | Y | Aib | E | G | T | F | - | S | D | Y | S | - | D-Iva | L | D | R | Aib | A | Q | Q | D | αMeF | V | N | W | L | L | A | Q | R | P | S | G | A | P | P | P | S | R | NH2 | 106 |
| 101 | Me | Y | Aib | E | G | T | F | - | S | D | Y | S | - | D-Iva | L | D | R | Aib | A | Q | Aib | D | αMeF | V | N | W | L | L | A | Q | R | P | S | G | A | P | P | P | S | R | NH2 | 107 |
| 102 | Me | Y | Aib | E | G | T | F | - | S | D | Y | S | - | A | L | D | R | Aib | A | Q | Q | N | F | V | N | W | L | L | A | Q | R | P | S | G | A | P | P | P | S | R | NH2 | 108 |
| 103 | Me | Y | Aib | E | G | T | F | - | S | D | Y | S | - | D-Iva | L | D | R | Aib | A | Q | Aib | N | αMeF | V | N | W | L | L | A | Q | R | P | S | G | A | P | P | P | S | R | NH2 | 109 |
| 104 | Me | Y | Aib | E | G | T | Iva | - | S | D | Y | S | - | D-Iva | L | D | R | Aib | A | Q | Aib | D | αMeF | V | N | W | L | L | A | Q | R | P | S | G | A | P | P | P | S | R | NH2 | 110 |
| 105 | Me | Y | Aib | E | G | T | Iva | - | S | D | Y | S | - | D-Iva | L | D | R | Aib | A | Q | Aib | N | αMeF | V | N | W | L | L | A | Q | R | P | S | G | A | P | P | P | S | R | NH2 | 111 |
| 106 | Me | Y | Aib | E | G | T | Iva | - | S | D | Y | S | - | A | L | D | R | Aib | A | Q | Q | N | αMeF | V | N | W | L | L | A | Q | R | P | S | G | A | P | P | P | S | R | NH2 | 112 |
| 107 | Me | Y | Aib | E | G | T | F | - | S | D | Y | S | - | A | L | D | R | Aib | A | Q | Aib | N | αMeF | V | N | W | L | L | A | Q | R | P | S | G | A | P | P | P | S | R | NH2 | 113 |
| 108 | Me | Y | Aib | E | G | T | Iva | - | S | D | Y | S | - | D-Iva | L | D | R | Aib | A | Q | Aib | D | F | V | N | W | L | L | A | Q | R | P | S | G | A | P | P | P | S | R | NH2 | 114 |
| 109 | Me | Y | Aib | E | G | T | F | - | S | D | Y | S | - | D-Iva | L | D | R | Aib | A | Q | Aib | D | αMeF | V | N | W | Iva | L | A | Q | R | P | S | G | A | P | P | P | S | R | NH2 | 115 |
| 110 | Me | Y | Aib | E | G | T | F | - | S | D | Y | S | - | D-Iva | L | D | R | Aib | A | Q | Aib | N | αMeF | V | N | W | Iva | L | A | Q | R | P | S | G | A | P | P | P | S | R | NH2 | 116 |
| 111 | Me | Y | Aib | E | G | T | F | - | S | D | Y | S | - | A | L | D | R | - | A | Q | Aib | N | F | V | N | W | Iva | L | A | Q | R | P | S | G | A | P | P | P | S | R | NH2 | 117 |
| 112 | Me | Y | Aib | E | G | T | Iva | - | S | D | Y | S | - | A | L | D | R | - | A | Q | Aib | N | αMeF | V | N | W | Iva | L | A | Q | R | P | S | G | A | P | P | P | S | R | NH2 | 118 |
| 113 | Me | Y | Aib | E | G | T | F | - | S | D | Y | S | - | Aib | L | D | R | Aib | H | Q | Aib | N | αMeF | V | N | W | L | L | A | Q | R | P | S | G | A | P | P | P | S | R | NH2 | 119 |
| 114 | Me | Y | Aib | E | G | T | Iva | - | S | D | Y | S | - | A | L | D | R | - | H | Q | Aib | N | F | V | N | W | L | L | A | Q | R | P | S | G | A | P | P | P | S | R | NH2 | 120 |
| 115 | Me | Y | Aib | E | G | T | F | - | S | D | Y | S | - | A | L | D | R | Aib | H | Q | Aib | N | αMeF | V | N | W | Iva | L | A | Q | R | P | S | G | A | P | P | P | S | R | NH2 | 121 |
| 116 | Me | Y | Aib | E | G | T | F | - | S | D | Y | S | - | D-Iva | L | D | R | Aib | H | Q | Aib | N | αMeF | V | N | W | Iva | L | A | Q | R | P | S | G | A | P | P | P | S | R | NH2 | 122 |
| 117 | Me | Y | Aib | E | G | T | Iva | - | S | D | Y | S | - | D-Iva | L | D | R | Aib | A | Q | Aib | N | αMeF | V | N | W | Iva | L | A | Q | R | P | S | G | A | P | P | P | S | R | NH2 | 123 |
| 118 | Me | Y | Aib | E | G | T | Iva | - | S | D | Y | S | - | D-Iva | L | D | R | Aib | A | Q | Aib | D | F | V | N | W | Iva | L | A | Q | R | P | S | G | A | P | P | P | S | R | NH2 | 124 |
| 119 | Me | Y | Aib | E | G | T | F | - | S | D | Y | S | - | A | L | D | R | - | A | Q | Aib | N | F | V | N | W | Iva | L | A | Q | R | P | S | G | A | P | P | P | S | R | NH2 | 125 |
| 120 | Me | Y | Aib | E | G | T | Iva | - | S | D | Y | S | - | A | L | D | R | Aib | A | Q | Aib | S | F | V | N | W | Iva | L | A | Q | R | P | S | G | A | P | P | P | S | R | NH2 | 126 |
| 121 | H- | Y | Aib | E | G | T | F | - | S | D | Y | S | - | A | L | D | R | Aib | A | Q | Q | N | F | V | N | W | Iva | L | A | Q | R | P | S | G | A | P | P | P | S | R | NH2 | 127 |
| 122 | H- | Y | Aib | E | G | T | F | - | S | D | Y | S | - | D-Iva | L | D | R | Aib | A | Q | Aib | N | F | V | N | W | Iva | L | A | Q | R | P | S | G | A | P | P | P | S | R | NH2 | 128 |
| 123 | Me | Y | Aib | E | G | T | F | - | S | D | Y | S | - | A | L | D | R | - | A | Q | Q | D | F | V | N | W | Iva | L | A | Q | R | P | S | G | A | P | P | P | S | R | NH2 | 129 |

FIG. 8D

| Compound | N | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 | 38 | 39 | 40 | C | SEQ ID NO |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| 124 | Me | Y | Aib | E | G | T | F | – | S | D | Y | S | – | A | L | D | R | – | A | Q | Aib | S | F | V | N | W | Iva | L | A | Q | R | P | S | S | G | A | P | P | P | S | R | NH2 | 130 |
| 125 | Me | Y | Aib | E | G | T | F | – | S | D | Y | S | – | A | L | D | R | – | A | Q | Aib | S | αMeF | V | N | W | Iva | L | A | Q | R | P | S | S | G | A | P | P | P | S | R | NH2 | 131 |
| 126 | Me | Y | Aib | E | G | T | F | – | S | D | Y | S | – | A | L | D | R | – | A | Q | Aib | S | F | V | N | W | Iva | L | A | Q | R | P | S | S | G | A | P | P | P | S | R | NH2 | 132 |
| 127 | Me | Y | Aib | E | G | T | F | Iva | S | D | Y | S | – | A | L | D | R | – | A | Q | Aib | S | F | V | N | W | Iva | L | A | Q | R | P | S | S | G | A | P | P | P | S | R | NH2 | 133 |
| 128 | Me | Y | Aib | E | G | T | Iva | – | S | D | Y | S | – | A | L | D | R | – | A | Q | Aib | S | F | V | N | W | Iva | L | A | Q | R | P | S | S | G | A | P | P | P | S | R | NH2 | 134 |
| 129 | Me | Y | Aib | E | G | T | F | – | S | D | Y | S | – | A | L | D | R | – | A | Q | Q | S | F | V | N | W | L | L | A | Q | R | P | S | S | G | A | P | P | P | S |   | NH2 | 135 |
| 130 | Me | Y | Aib | E | G | T | F | – | S | D | Y | S | – | D-Iva | L | D | R | – | A | Q | Q | D | F | V | N | W | Iva | L | A | Q | R | P | S | S | G | A | P | P | P | S | R | NH2 | 136 |
| 131 | Me | Y | Aib | E | G | T | F | – | S | D | Y | S | – | A | L | D | R | – | A | Q | Q | D | F | V | N | W | L | L | A | Q | R | P | S | S | G | A | P | P | P | S | R | NH2 | 137 |
| 132 | Me | Y | Aib | E | G | T | Iva | – | S | D | Y | S | – | A | L | D | R | – | A | Q | Q | D | F | V | N | W | Iva | L | A | Q | R | P | S | S | G | A | P | P | P | S | R | NH2 | 138 |
| 133 | Me | Y | Aib | E | G | T | F | – | S | D | Y | S | – | A | L | D | R | – | A | Q | Q | N | αMeF | V | N | W | L | L | A | Q | R | P | S | S | G | A | P | P | P | S | R | NH2 | 139 |
| 134 | Me | Y | Aib | E | G | T | F | – | S | D | Y | S | – | A | L | D | R | – | A | Q | Q | N | αMeF | V | N | W | Iva | L | A | Q | R | P | S | S | G | A | P | P | P | S | R | NH2 | 140 |
| 135 | Me | Y | Aib | E | G | T | F | – | S | D | Y | S | – | A | L | D | R | – | A | Q | Q | D | F | V | N | W | L | L | A | Q | R | P | S | S | G | A | P | P | P | S | R | NH2 | 141 |
| 136 | Me | Y | Aib | E | G | T | F | – | S | D | Y | S | – | A | L | D | R | – | A | Q | Aib | S | F | V | N | W | L | L | A | Q | R | P | S | S | G | A | P | P | P | S | R | NH2 | 142 |
| 137 | Me | Y | Aib | E | G | T | F | – | S | D | Y | S | – | D-Iva | L | D | R | Aib | A | Q | Q | S | F | V | N | W | L | L | A | Q | R | P | S | S | G | A | P | P | P | S | R | NH2 | 143 |
| 138 | Me | Y | Aib | E | G | T | F | – | S | D | Y | S | – | A | L | D | R | – | A | Q | Q | D | F | V | N | W | L | L | A | Q | R | P | S | S | G | A | P | P | P | S | R | NH2 | 144 |
| 139 | Me | Y | Aib | E | G | T | F | – | S | D | Y | S | – | A | L | D | R | – | A | Q | Q | D | F | V | N | W | Iva | L | A | Q | R | P | S | S | G | A | P | P | P | S | R | NH2 | 145 |
| 140 | Me | Y | Aib | E | G | T | F | – | S | D | Y | S | – | A | L | D | R | – | A | Q | Q | S | αMeF | V | N | W | L | L | A | Q | R | P | S | S | G | A | P | P | P | S | R | NH2 | 146 |
| 141 | Me | Y | Aib | E | G | T | F | – | S | D | Y | S | – | A | L | D | R | – | H | Q | Q | S | F | V | N | W | L | L | A | Q | R | P | S | S | G | A | P | P | P | S | R | NH2 | 147 |
| 142 | Me | Y | Aib | E | G | T | F | – | S | D | Y | S | – | A | L | D | R | – | H | Q | Q | D | F | V | N | W | L | L | A | Q | R | P | S | S | G | A | P | P | P | S | R | NH2 | 148 |
| 143 | Me | Y | Aib | E | G | T | F | – | S | D | Y | S | – | D-Iva | L | D | R | – | H | Q | Q | D | F | V | N | W | Iva | L | A | Q | R | P | S | S | G | A | P | P | P | S | R | NH2 | 149 |
| 144 | Me | Y | Aib | E | G | T | F | Iva | S | D | Y | S | – | A | L | D | R | – | H | Q | Q | D | F | V | N | W | Iva | L | A | Q | R | P | S | S | G | A | P | P | P | S | R | NH2 | 150 |
| 145 | Me | Y | Aib | E | G | T | Iva | – | S | D | Y | S | – | A | L | D | R | – | H | Q | Q | D | F | V | N | W | Iva | L | A | Q | R | P | S | S | G | A | P | P | P | S | R | NH2 | 151 |
| 146 | Me | Y | Aib | E | G | T | F | – | S | D | Y | S | – | Aib | L | D | R | Aib | A | Q | Aib | S | F | V | N | W | L | L | A | Q | R | P | S | S | G | A | P | P | P | S | R | NH2 | 152 |
| 147 | Me | Y | Aib | E | G | T | F | – | S | D | Y | S | – | D-Iva | L | D | R | Aib | H | Q | Aib | N | αMeF | V | N | W | L | L | A | Q | R | P | S | S | G | A | P | P | P | S | R | NH2 | 153 |
| 148 | Me | Y | Aib | E | G | T | Iva | – | S | D | Y | S | – | A | L | D | R | – | A | Q | Aib | N | F | V | N | W | Iva | L | A | Q | R | P | S | S | G | A | P | P | P | S | R | NH2 | 154 |
| 149 | Me | Y | Aib | E | G | T | F | – | S | D | Y | S | – | Aib | L | D | R | Aib | A | Q | Aib | N | F | V | N | W | Iva | L | A | Q | R | P | S | S | G | A | P | P | P | S | R | NH2 | 155 |
| 150 | Ac | Y | Aib | E | G | T | F | – | S | D | Y | S | – | A | L | D | R | Aib | A | Q | Q | N | F | V | N | W | L | L | A | Q | R | P | S | S | G | A | P | P | P | S | R | NH2 | 156 |
| 151 | Ac | Y | Aib | E | G | T | Iva | – | S | D | Y | S | – | D-Iva | L | D | R | Aib | A | Q | Q | D | F | V | N | W | Iva | L | A | Q | R | P | S | S | G | A | P | P | P | S | R | NH2 | 157 |
| 152 | Ac | Y | Aib | E | G | T | Iva | – | S | D | Y | S | – | A | L | D | R | – | A | Q | Aib | N | F | V | N | W | Iva | L | A | Q | R | P | S | S | G | A | P | P | P | S | R | NH2 | 158 |
| 153 | Ac | Y | Aib | E | G | T | F | – | S | D | Y | S | – | Aib | L | D | R | Aib | A | Q | Aib | N | αMeF | V | N | W | Iva | L | A | Q | R | P | S | S | G | A | P | P | P | S | R | NH2 | 159 |
| 154 | Ac | Y | Aib | E | G | T | Iva | – | S | D | Y | S | – | A | L | D | R | – | H | Q | Q | S | F | V | N | W | L | L | A | Q | R | P | S | S | G | A | P | P | P | S | R | NH2 | 160 |
| 155 | Ac | Y | Aib | E | G | T | F | – | S | D | Y | S | – | A | L | D | R | Aib | H | Q | Aib | N | F | V | N | W | Iva | L | A | Q | R | P | S | S | G | A | P | P | P | S | R | NH2 | 161 |
| 156 | Ac | Y | Aib | E | G | T | Iva | – | S | D | Y | S | – | A | L | D | R | Aib | H | Q | Aib | N | F | V | N | W | Iva | L | A | Q | R | P | S | S | G | A | P | P | P | S | R | NH2 | 162 |
| 157 | Ac | Y | Aib | E | G | T | Iva | – | S | D | Y | S | – | Aib | L | D | R | Aib | H | Q | Aib | N | F | V | N | W | Iva | L | A | Q | R | P | S | S | G | A | P | P | P | S | R | NH2 | 163 |

D-A: D-Alanine, αMeF: α-methyl Phenylalanine, D-Iva: D-Isovaline

FIG. 9A

| compond # | N | 1 | 2 | 3 | 4 | 5 | 6 | 7 | 8 | 9 | 10 | 11 | 12 | 13 |
|---|---|---|---|---|---|---|---|---|---|---|---|---|---|---|
| 158 | H- | Y | Aib | E | G | T | V | V | S | L | Y | S | K(PEG(2)-Pal) | Aib |
| 159 | H- | Y | Aib | E | G | T | V | V | S | L | Y | S | K(Pal) | Aib |
| 160 | H- | Y | Aib | E | G | T | V | V | S | L | Y | S | I | Aib |
| 161 | H- | Y | Aib | E | G | T | V | V | S | L | Y | S | I | Aib |
| 162 | H- | Y | Aib | E | G | T | V | V | S | L | Y | S | I | Aib |
| 163 | H- | Y | Aib | E | G | T | V | V | S | L | Y | S | I | Aib |
| 164 | H- | Y | Aib | E | G | T | V | V | S | L | Y | S | K(Pal) | Aib |
| 165 | H- | Y | Aib | E | G | T | V | V | S | L | Y | S | K(Eda) | Aib |
| 166 | H- | Y | Aib | E | G | T | V | V | S | L | Y | S | K(GGGG-Pal) | Aib |
| 167 | H- | Y | Aib | E | G | T | V | V | S | L | Y | S | K(Eda-GGGG-) | Aib |
| 168 | H- | Y | Aib | E | G | T | V | V | S | L | Y | S | K(Pal) | Aib |
| 169 | H- | Y | Aib | E | G | T | V | V | S | L | Y | S | K(Eda) | Aib |
| 170 | H- | Y | Aib | E | G | T | V | V | S | L | Y | S | K(GGGG-Pal) | Aib |
| 171 | H- | Y | Aib | E | G | T | V | V | S | L | Y | S | K(Eda-GGGG-) | Aib |
| 172 | Me | Y | Aib | E | G | T | F | I | S | D | Y | S | K(PEG(2)-Pal) | A |
| 173 | Me | Y | Aib | E | G | T | F | I | S | D | Y | S | K(PEG(2)-Ac) | A |
| 174 | Me | Y | Aib | E | G | T | F | I | S | D | Y | S | K(PEG(2)-hexanoyl) | A |
| 175 | Me | Y | Aib | E | G | T | F | I | S | D | Y | S | K(PEG(2)-dodecanoyl) | A |
| 176 | Me | Y | Aib | E | G | T | F | I | S | D | Y | S | K(PEG(2)-octadecanoyl) | A |
| 177 | Me | Y | Aib | E | G | T | F | I | S | D | Y | S | K(PEG(2)-Pal) | A |
| 178 | Me | Y | Aib | E | G | T | F | I | S | D | Y | S | K(PEG(2)-Ac) | A |
| 179 | Me | Y | Aib | E | G | T | F | I | S | D | Y | S | K(PEG(2)-hexanoyl) | A |
| 180 | Me | Y | Aib | E | G | T | F | I | S | D | Y | S | K(PEG(2)-dodecanoyl) | A |
| 181 | Me | Y | Aib | E | G | T | F | I | S | D | Y | S | K(PEG(2)-octadecanoyl) | A |
| 182 | Me | Y | Aib | E | G | T | F | I | S | D | Y | S | K(PEG(2)-decanoyl) | A |
| 183 | Me | Y | Aib | E | G | T | F | I | S | D | Y | S | K(PEG(2)-undecanoyl) | A |
| 184 | Me | Y | Aib | E | G | T | F | I | S | D | Y | S | K(PEG(2)-dodecanoyl) | A |
| 185 | Me | Y | Aib | E | G | T | F | I | S | D | Y | S | K(PEG(2)-tridecanoyl) | A |
| 186 | Me | Y | Aib | E | G | T | F | I | S | D | Y | S | K(PEG(2)-tetradecanoyl) | A |
| 187 | Me | Y | Aib | E | G | T | F | I | S | D | Y | S | K(PEG(2)-pentadecanoyl) | A |
| 188 | Me | Y | Aib | E | G | T | F | I | S | D | Y | S | K(PEG(2)-Dda) | A |
| 189 | Me | Y | Aib | E | G | T | F | I | S | D | Y | S | K(PEG(4)-dodecanoyl) | A |
| 190 | Me | Y | Aib | E | G | T | F | I | S | D | Y | S | K(PEG(4)-Pal) | A |
| 191 | Me | Y | Aib | E | G | T | F | I | S | D | Y | S | K(Dodecanoyl-PEG(2)-) | A |
| 192 | Me | Y | Aib | E | G | T | F | I | S | D | Y | S | K(Dodecanoyl-PEG(2)-) | A |
| 193 | Me | Y | Aib | E | G | T | F | I | S | D | Y | S | K(Dodecanoyl-PEG(2)-) | A |
| 194 | Me | Y | Aib | E | G | T | F | I | S | D | Y | S | K(Dodecanoyl-PEG(2)-) | A |
| 195 | Me | Y | Aib | E | G | T | F | I | S | D | Y | S | K(Dodecanoyl-PEG(2)-) | A |
| 196 | Me | Y | Aib | E | G | T | F | I | S | D | Y | S | K(Dodecanoyl-PEG(2)-) | A |
| 197 | Me | Y | Aib | E | G | T | F | I | S | D | Y | S | K(Dodecanoyl-PEG(2)-) | A |
| 198 | Me | Y | Aib | E | G | T | F | I | S | D | Y | S | K(Dodecanoyl-PEG(2)-) | A |
| 199 | Me | Y | Aib | E | G | T | F | I | S | D | Y | S | K(Dodecanoyl-PEG(2)-) | Diva |
| 200 | Me | Y | Aib | E | G | T | Iva | I | S | D | Y | S | K(Dodecanoyl-PEG(2)-) | A |
| 201 | Me | Y | Aib | E | G | T | F | I | S | D | Y | S | K(Dodecanoyl-PEG(2)-) | A |
| 202 | Me | Y | Aib | E | G | T | F | I | S | D | Y | S | K(Dodecanoyl-PEG(2)-) | A |
| 203 | Me | Y | Aib | E | G | T | F | I | S | D | Y | S | K(Dodecanoyl-PEG(2)-) | A |
| 204 | Me | Y | Aib | E | G | T | F | I | S | D | Y | S | K(Dodecanoyl-PEG(2)-) | A |
| 205 | Me | Y | Aib | E | G | T | F | I | S | D | Y | S | K(Dodecanoyl-PEG(2)-) | A |
| 206 | Me | Y | Aib | E | G | T | F | I | S | D | Y | S | K(Dodecanoyl-PEG(2)-) | Diva |
| 207 | Me | Y | Aib | E | G | T | Iva | I | S | D | Y | S | K(Dodecanoyl-PEG(2)-) | A |
| 208 | Me | Y | Aib | E | G | T | F | I | S | D | Y | S | K(Dodecanoyl-PEG(2)-) | A |
| 209 | Me | Y | Aib | E | G | T | F | I | S | D | Y | S | K(Dodecanoyl-PEG(2)-) | A |
| 210 | Me | Y | Aib | E | G | T | F | I | S | D | Y | S | K(Dodecanoyl-PEG(2)-) | A |
| 211 | Me | Y | Aib | E | G | T | F | I | S | D | Y | S | K(Dodecanoyl-PEG(2)-) | A |
| 212 | Me | Y | Aib | E | G | T | F | I | S | D | Y | S | K(Dodecanoyl-PEG(2)-) | A |
| 213 | Me | Y | Aib | E | G | T | F | I | S | D | Y | S | K(Dodecanoyl-PEG(2)-) | A |
| 214 | Me | Y | Aib | E | G | T | Iva | I | S | D | Y | S | K(Dodecanoyl-PEG(2)-) | A |
| 215 | Me | Y | Aib | E | G | T | F | I | S | D | Y | S | K(Dodecanoyl-PEG(2)-) | A |
| 216 | Me | Y | Aib | E | G | T | F | I | S | D | Y | S | K(Dodecanoyl-PEG(2)-) | A |
| 217 | Me | Y | Aib | E | G | T | F | I | S | D | Y | S | K(Dodecanoyl-PEG(2)-) | A |
| 218 | Me | Y | Aib | E | G | T | Iva | I | S | D | Y | S | K(Dodecanoyl-PEG(2)-) | A |
| 219 | Me | Y | Aib | E | G | T | Iva | I | S | D | Y | S | K(Dodecanoyl-PEG(2)-) | A |
| 220 | Me | Y | Aib | E | G | T | F | I | S | D | Y | S | K(Dodecanoyl-PEG(2)-) | A |
| 221 | Me | Y | Aib | E | G | T | F | I | S | D | Y | S | K(Dodecanoyl-PEG(2)-) | A |
| 222 | Me | Y | Aib | E | G | T | F | I | S | D | Y | S | K(Dodecanoyl-PEG(2)-) | A |
| 223 | Me | Y | Aib | E | G | T | F | I | S | D | Y | S | K(Dodecanoyl-PEG(2)-) | A |
| 224 | Me | Y | Aib | E | G | T | F | I | S | D | Y | S | K(Dodecanoyl-PEG(2)-) | A |
| 225 | Me | Y | Aib | E | G | T | F | I | S | D | Y | S | C(1S2S-11NC-acetyl) | A |
| 226 | Me | Y | Aib | E | G | T | Iva | I | S | D | Y | S | I | Aib |
| 227 | Me | Y | Aib | E | G | T | Iva | I | S | D | Y | S | I | Aib |
| 228 | Me | Y | Aib | E | G | T | Iva | I | S | D | Y | S |  | Aib |
| 229 | Me | Y | Aib | E | G | T | Iva | I | S | D | Y | S | K(PEG(2)-dodec) | Aib |
| 230 | Me | Y | Aib | E | G | T | Iva | I | S | D | Y | S | K(PEG(2)-Pal) | Aib |

Fig. 9B

| | | | | Amino acid | | | | |
|---|---|---|---|---|---|---|---|---|
| 14 | 15 | 16 | 17 | 18 | 19 | 20 | 21 | 22 |
| L | D | K | Q | A | Q | Aib | E | F |
| L | D | K | Q | A | Q | Aib | E | F |
| L | D | K | Q | A | Q | Aib | E | F |
| L | D | K | Q | A | Q | Aib | E | F |
| L | D | K | Q | A | Q | Aib | E | F |
| L | D | K | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | I | H | Q | Q | D | F |
| L | D | R | I | H | Q | Q | D | F |
| L | D | R | I | H | Q | Q | D | F |
| L | D | R | I | H | Q | Q | D | F |
| L | D | R | I | H | Q | Q | D | F |
| L | D | R | I | H | Q | Q | D | F |
| L | D | R | I | H | Q | Q | D | F |
| L | D | R | I | H | Q | Q | D | F |
| L | D | R | I | H | Q | Q | D | F |
| L | D | R | I | H | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | aMeF |
| L | D | R | I | A | Q | Q | S | F |
| L | D | R | I | A | Q | Aib | N | F |
| L | D | R | Aib | A | Q | Q | D | F |
| L | D | R | I | A | Q | Q | D | F |
| L | D | R | I | A | Q | Q | D | F |
| L | D | R | I | A | Q | Q | D | F |
| L | D | R | I | A | Q | Q | D | aMeF |
| L | D | R | I | A | Q | Q | S | F |
| L | D | R | I | A | Q | Aib | N | F |
| L | D | R | Aib | A | Q | Q | D | F |
| L | D | R | I | A | Q | Q | D | F |
| L | D | R | I | A | Q | Q | D | F |
| L | D | R | I | H | Q | Q | D | aMeF |
| L | D | R | I | H | Q | Aib | N | F |
| L | D | R | Aib | H | Q | Q | D | F |
| L | D | R | Aib | A | Q | Aib | N | F |
| L | D | R | I | A | Q | Aib | N | aMeF |
| L | D | R | Aib | A | Q | Q | D | aMeF |
| L | D | R | Aib | A | Q | Aib | N | F |
| L | D | R | Aib | H | Q | Aib | N | F |
| L | D | R | I | H | Q | Aib | N | aMeF |
| L | D | R | Aib | H | Q | Q | D | aMeF |
| L | D | R | Aib | H | Q | Aib | N | F |
| L | D | R | Aib | H | Q | Aib | N | F |
| L | D | R | I | A | Q | Q | S | F |
| L | D | R | I | A | Q | Q | S | aMeF |
| L | D | R | I | H | Q | Q | S | F |
| L | D | R | I | H | Q | Q | S | aMeF |
| L | D | R | Aib | H | Q | Q | S | F |
| L | D | R | I | H | Q | Q | D | F |
| L | D | R | K(PEG(2)-dodec) | A | Q | Aib | N | F |
| L | D | R | K(PEG(2)-Pal) | A | Q | Aib | N | F |
| L | D | R | K(Eda-PEG(2)-) | A | Q | Aib | N | F |
| L | D | R | Aib | A | Q | Aib | N | F |
| L | D | R | Aib | A | Q | Aib | N | F |

FIG. 9C

| 23 | 24 | 25 | 26 | 27 | 28 | 29 | 30 | 31 | 32 | 33 | 34 | 35 | 36 | 37 | 38 | 39 | 40 | C | SEQ ID # |
|---|---|---|---|---|---|---|---|---|---|---|---|---|---|---|---|---|---|---|---|
| V | K | W | L | L | A | Q | K | | | | | | | | | | | NH2 | 171 |
| V | K | W | L | L | A | Q | K | | | | | | | | | | | NH2 | 172 |
| V | K | W | L | L | A | Q | K | K(PEG(2)-Pal) | | | | | | | | | | NH2 | 173 |
| V | K | W | L | L | A | Q | K | K(Pal) | | | | | | | | | | NH2 | 174 |
| V | K | W | L | L | K | G | K(PEG(2)-Pal) | | | | | | | | | | | NH2 | 175 |
| V | K | W | L | L | K | G | K(Pal) | | | | | | | | | | | NH2 | 176 |
| V | R | W | L | L | R | G | G | P | S | S | G | A | P | P | P | S | | NH2 | 177 |
| V | R | W | L | L | R | G | G | P | S | S | G | A | P | P | P | S | | NH2 | 178 |
| V | R | W | L | L | R | G | G | P | S | S | G | A | P | P | P | S | | NH2 | 179 |
| V | R | W | L | L | R | G | G | P | S | S | G | A | P | P | P | S | | NH2 | 180 |
| V | K(Ac) | W | L | L | R | G | G | P | S | S | G | A | P | P | P | S | | NH2 | 181 |
| V | K(Ac) | W | L | L | R | G | G | P | S | S | G | A | P | P | P | S | | NH2 | 182 |
| V | K(Ac) | W | L | L | R | G | G | P | S | S | G | A | P | P | P | S | | NH2 | 183 |
| V | K(Ac) | W | L | L | R | G | G | P | S | S | G | A | P | P | P | S | | NH2 | 184 |
| V | N | W | L | L | A | Q | R | P | S | S | G | A | P | P | P | S | | NH2 | 185 |
| V | N | W | L | L | A | Q | R | P | S | S | G | A | P | P | P | S | | NH2 | 186 |
| V | N | W | L | L | A | Q | R | P | S | S | G | A | P | P | P | S | | NH2 | 187 |
| V | N | W | L | L | A | Q | R | P | S | S | G | A | P | P | P | S | | NH2 | 188 |
| V | N | W | L | L | A | Q | R | P | S | S | G | A | P | P | P | S | | NH2 | 189 |
| V | N | W | L | L | A | Q | R | P | S | S | G | A | P | P | P | S | R | NH2 | 190 |
| V | N | W | L | L | A | Q | R | P | S | S | G | A | P | P | P | S | R | NH2 | 191 |
| V | N | W | L | L | A | Q | R | P | S | S | G | A | P | P | P | S | R | NH2 | 192 |
| V | N | W | L | L | A | Q | R | P | S | S | G | A | P | P | P | S | R | NH2 | 193 |
| V | N | W | L | L | A | Q | R | P | S | S | G | A | P | P | P | S | R | NH2 | 194 |
| V | N | W | L | L | A | Q | R | P | S | S | G | A | P | P | P | S | R | NH2 | 195 |
| V | N | W | L | L | A | Q | R | P | S | S | G | A | P | P | P | S | R | NH2 | 196 |
| V | N | W | L | L | A | Q | R | P | S | S | G | A | P | P | P | S | R | NH2 | 197 |
| V | N | W | L | L | A | Q | R | P | S | S | G | A | P | P | P | S | R | NH2 | 198 |
| V | N | W | L | L | A | Q | R | P | S | S | G | A | P | P | P | S | R | NH2 | 199 |
| V | N | W | L | L | A | Q | R | P | S | S | G | A | P | P | P | S | R | NH2 | 200 |
| V | N | W | L | L | A | Q | R | P | S | S | G | A | P | P | P | S | R | NH2 | 201 |
| V | N | W | L | L | A | Q | R | P | S | S | G | A | P | P | P | S | R | NH2 | 202 |
| V | N | W | L | L | A | Q | R | P | S | S | G | A | P | P | P | S | R | NH2 | 203 |
| V | N | W | L | L | A | Q | R | P | S | S | G | A | P | P | P | S | | NH2 | 204 |
| V | N | W | L | L | A | Q | R | P | S | S | G | A | P | P | P | S | | NH2 | 205 |
| V | N | W | Iva | L | A | Q | R | P | S | S | G | A | P | P | P | S | R | NH2 | 206 |
| V | N | αMeF | L | L | A | Q | R | P | S | S | G | A | P | P | P | S | R | NH2 | 207 |
| V | N | W | L | L | A | Q | R | P | S | S | G | A | P | P | P | S | R | NH2 | 208 |
| V | N | W | L | L | A | Q | R | P | S | S | G | A | P | P | P | S | R | NH2 | 209 |
| V | N | W | L | L | A | Q | R | P | S | S | G | A | P | P | P | S | R | NH2 | 210 |
| V | N | W | L | L | A | Q | R | P | S | S | G | A | P | P | P | S | R | NH2 | 211 |
| V | N | W | L | L | A | Q | R | P | S | S | G | A | P | P | P | S | R | NH2 | 212 |
| V | N | W | L | L | A | Q | R | P | S | S | G | A | P | P | P | S | R | NH2 | 213 |
| V | N | W | Iva | L | A | Q | R | P | S | S | G | A | P | P | P | S | | NH2 | 214 |
| V | N | W | L | L | A | Q | R | P | S | S | G | A | P | P | P | S | | NH2 | 215 |
| V | N | W | L | L | A | Q | R | P | S | S | G | A | P | P | P | S | | NH2 | 216 |
| V | N | W | L | L | A | Q | R | P | S | S | G | A | P | P | P | S | | NH2 | 217 |
| V | N | W | L | L | A | Q | R | P | S | S | G | A | P | P | P | S | | NH2 | 218 |
| V | N | W | L | L | A | Q | R | P | S | S | G | A | P | P | P | S | | NH2 | 219 |
| V | N | W | L | L | A | Q | R | P | S | S | G | A | P | P | P | S | | NH2 | 220 |
| V | N | W | L | L | A | Q | R | P | S | S | G | A | P | P | P | S | | NH2 | 221 |
| V | N | W | L | L | A | Q | R | P | S | S | G | A | P | P | P | S | | NH2 | 222 |
| V | N | W | L | L | A | Q | R | P | S | S | G | A | P | P | P | S | | NH2 | 223 |
| V | N | W | Iva | L | A | Q | R | P | S | S | G | A | P | P | P | S | | NH2 | 224 |
| V | N | W | Iva | L | A | Q | R | P | S | S | G | A | P | P | P | S | | NH2 | 225 |
| V | N | W | L | L | A | Q | R | P | S | S | G | A | P | P | P | S | | NH2 | 226 |
| V | N | W | L | L | A | Q | R | P | S | S | G | A | P | P | P | S | | NH2 | 227 |
| V | N | W | Iva | L | A | Q | R | P | S | S | G | A | P | P | P | S | | NH2 | 228 |
| V | N | W | Iva | L | A | Q | R | P | S | S | G | A | P | P | P | S | | NH2 | 229 |
| V | N | W | L | L | A | Q | R | P | S | S | G | A | P | P | P | S | | NH2 | 230 |
| V | N | W | L | L | A | Q | R | P | S | S | G | A | P | P | P | S | | NH2 | 231 |
| V | N | W | Iva | L | A | Q | R | P | S | S | G | A | P | P | P | S | | NH2 | 232 |
| V | N | W | Iva | L | A | Q | R | P | S | S | G | A | P | P | P | S | | NH2 | 233 |
| V | N | W | Iva | L | A | Q | R | P | S | S | G | A | P | P | P | S | | NH2 | 234 |
| V | N | W | Iva | L | A | Q | R | P | S | S | G | A | P | P | P | S | | NH2 | 235 |
| V | N | W | Iva | L | A | Q | R | P | S | S | G | A | P | P | P | S | | NH2 | 236 |
| V | N | W | Iva | L | A | Q | R | P | S | S | G | A | P | P | P | S | | NH2 | 237 |
| V | N | W | L | L | A | Q | R | P | S | S | G | A | P | P | P | S | | NH2 | 238 |
| V | N | W | Iva | L | A | Q | R | P | S | S | G | A | P | P | P | S | | NH2 | 239 |
| V | N | W | Iva | L | A | Q | R | P | S | S | G | A | P | P | P | S | | NH2 | 240 |
| V | N | W | Iva | L | A | Q | R | P | S | S | G | A | P | P | P | S | | NH2 | 241 |
| V | N | W | Iva | L | A | Q | R | P | S | S | G | A | P | P | P | S | | NH2 | 242 |
| V | N | W | Iva | L | A | Q | R | P | S | S | G | A | P | P | P | S | | NH2 | 243 |

FIG. 9D

| compound # | N | 1 | 2 | 3 | 4 | 5 | 6 | 7 | 8 | 9 | 10 | 11 | 12 | 13 |
|---|---|---|---|---|---|---|---|---|---|---|---|---|---|---|
| 231 | Me | Y | Aib | E | G | T | Iva | I | S | D | Y | S | K(Eda-PEG(2)-) | Aib |
| 232 | Me | Y | Aib | E | G | T | F | I | S | D | Y | S | I | A |
| 233 | Me | Y | Aib | E | G | T | F | I | S | D | Y | S | I | A |
| 234 | Me | Y | Aib | E | G | T | F | I | S | D | Y | S | I | A |
| 235 | Me | Y | Aib | E | G | T | Iva | I | S | D | Y | S | I | Aib |
| 236 | Me | Y | Aib | E | G | T | Iva | I | S | D | Y | S | K(-PEG3-PEG3-isoGlu-Eda) | Aib |
| 237 | Me | Y | Aib | E | G | T | F | I | S | D | Y | S | I | A |
| 238 | Me | Y | Aib | E | G | T | F | I | S | D | Y | S | K(-PEG3-PEG3-IsoGlu-Eda) | A |
| 239 | Me | Y | Aib | E | G | T | F | I | S | D | Y | S | I | A |
| 240 | Me | Y | Aib | E | G | T | F | I | S | D | Y | S | I | A |
| 241 | Me | Y | Aib | E | G | T | F | I | S | D | Y | S | I | A |
| 242 | Me | Y | Aib | E | G | T | F | I | S | D | Y | S | K(-PEG3-PEG3-IsoGlu-Eda) | A |
| 243 | Me | Y | Aib | E | G | T | Iva | I | S | D | Y | S | I | Aib |
| 244 | H- | Y | Aib | E | G | T | V | V | S | L | Y | S | K(Eda-PEG(2)-) | Aib |
| 245 | Ac | Y | Aib | E | G | T | V | V | S | L | Y | S | K(Eda-GGGG-) | Aib |
| 246 | H- | Y | Aib | E | G | T | V | V | S | L | Y | S | K(Eicosanoyl-GGGG-) | Aib |
| 247 | H- | Y | Aib | E | G | T | V | V | S | L | Y | S | K(Eda-PEG(2)-) | Aib |
| 248 | Ac | Y | Aib | E | G | T | V | V | S | L | Y | S | K(Eda-GGGG-) | Aib |
| 249 | H- | Y | Aib | E | G | T | V | V | S | L | Y | S | K(Eicosanoyl-GGGG-) | Aib |
| 250 | Me | Y | Aib | E | G | T | Iva | I | S | D | Y | S | K(Eda-GGGG-) | Aib |
| 251 | Me | Y | Aib | E | G | T | Iva | I | S | D | Y | S | K(Eicosanoyl-PEG(2)-) | Aib |
| 252 | Ac | Y | Aib | E | G | T | Iva | I | S | D | Y | S | K(Eda-PEG(2)-) | Aib |
| 253 | Me | Y | Aib | E | G | T | Iva | I | S | D | Y | S | I | Aib |
| 254 | Me | Y | Aib | E | G | T | Iva | I | S | D | Y | S | I | Aib |
| 255 | Ac | Y | Aib | E | G | T | Iva | I | S | D | Y | S | I | Aib |
| 256 | H- | Y | Aib | E | G | T | V | V | S | L | Y | S | K(Eda-GGGG-) | Aib |
| 257 | H- | Y | Aib | E | G | T | V | V | S | L | Y | S | K(Octadecanoyl-GGGG-) | Aib |
| 258 | Ac | Y | Aib | E | G | T | V | V | S | L | Y | S | K(Octadecanoyl-GGGG-) | Aib |
| 259 | H- | Y | Aib | E | G | T | V | V | S | L | Y | S | K(Eda-GGGG-) | Aib |
| 260 | Ac | Y | Aib | E | G | T | V | V | S | L | Y | S | K(Eda-GGGG-) | Aib |
| 261 | H- | Y | Aib | E | G | T | V | V | S | L | Y | S | K(Octadecanoyl-GGGG-) | Aib |
| 262 | Me | Y | Aib | E | G | T | Iva | I | S | D | Y | S | K(Eda-GGGG-) | Aib |
| 263 | Me | Y | Aib | E | G | T | Iva | I | S | D | Y | S | K(Eda-GGGG-) | Aib |
| 264 | Ac | Y | Aib | E | G | T | Iva | I | S | D | Y | S | K(Eda-PEG(2)-) | Aib |
| 265 | Me | Y | Aib | E | G | T | Iva | I | S | D | Y | S | I | Aib |
| 266 | Me | Y | Aib | E | G | T | Iva | I | S | D | Y | S | I | Aib |
| 267 | Me | Y | Aib | E | G | T | Iva | I | S | D | Y | S | K(Eda-PEG(2)-) | Aib |
| 268 | Me | Y | Aib | E | G | T | Iva | I | S | D | Y | S | K(Eda-PEG(2)-) | Aib |
| 269 | Me | Y | Aib | E | G | T | Iva | I | S | D | Y | S | K(Eda-PEG(2)-) | Aib |
| 270 | Me | Y | Aib | E | G | T | Iva | I | S | D | Y | S | K(Eda-PEG(2)-) | Aib |
| 271 | Me | Y | Aib | E | G | T | Iva | I | S | D | Y | S | K(Eda-PEG(2)-) | E |
| 272 | Me | Y | Aib | E | G | T | Iva | I | S | D | Y | E | K(Eda-PEG(2)-) | Aib |
| 273 | Me | Y | Aib | E | G | E | Iva | I | S | D | Y | S | K(Eda-PEG(2)-) | Aib |
| 274 | Me | Y | Aib | E | G | T | Iva | I | S | D | Y | S | E | Aib |
| 275 | Me | Y | Aib | E | G | T | Iva | I | S | D | Y | S | K(Eda- - -) | Aib |
| 276 | Me | Y | Aib | E | G | T | Iva | I | S | D | Y | S | K(Eda-PEG3-) | Aib |
| 277 | Me | Y | Aib | E | G | T | Iva | I | S | D | Y | S | K(Eda-(PEG3)2-) | Aib |
| 278 | Me | Y | Aib | E | G | T | Iva | I | S | D | Y | S | K(Eda-(PEG3)3-) | Aib |
| 279 | Me | Y | Aib | E | G | T | Iva | I | S | D | Y | S | K(Eda-(PEG3)4-) | Aib |
| 280 | Me | Y | Aib | E | G | T | Iva | I | S | D | Y | S | K(Eda- - -) | Aib |
| 281 | Me | Y | Aib | E | G | T | Iva | I | S | D | Y | S | K(Eda-G-) | Aib |
| 282 | Me | Y | Aib | E | G | T | Iva | I | S | D | Y | S | K(Eda-GG-) | Aib |
| 283 | Me | Y | Aib | E | G | T | Iva | I | S | D | Y | S | K(Eda-GGG-) | Aib |
| 284 | Me | Y | Aib | E | G | T | Iva | I | S | D | Y | S | K(Eda-GGGGG-) | Aib |
| 285 | H- | Y | Aib | E | G | T | V | V | S | L | Y | S | I | Aib |
| 286 | H- | Y | Aib | E | G | T | V | V | S | L | Y | S | I | Aib |
| 287 | Me | Y | Aib | E | G | T | Iva | I | K(Eda-PEG(2)-) | D | Y | S | I | Aib |
| 288 | Me | Y | Aib | E | G | T | Iva | I | S | K(Eda-PEG(2)-) | Y | S | I | Aib |
| 289 | Me | Y | Aib | E | G | T | Iva | I | S | D | K(Eda-PEG(2)-) | S | I | Aib |
| 290 | Me | Y | Aib | E | G | T | Iva | I | S | D | Y | K(Eda-PEG(2)-) | I | Aib |
| 291 | Me | Y | Aib | E | G | T | Iva | I | S | D | Y | S | I | K(Eda-PEG(2)-) |
| 292 | Me | Y | Aib | E | G | T | Iva | I | S | D | Y | S | I | Aib |
| 293 | Me | Y | Aib | E | G | T | Iva | I | S | D | Y | S | I | Aib |
| 294 | Me | Y | Aib | E | G | T | Iva | I | S | D | Y | S | I | Aib |
| 295 | Me | Y | Aib | E | G | T | Iva | I | S | D | Y | S | I | Aib |
| 296 | Me | Y | Aib | E | G | T | Iva | I | S | D | Y | S | I | Aib |
| 297 | Me | Y | Aib | E | G | T | Iva | I | S | D | Y | S | I | Aib |
| 298 | Me | Y | Aib | E | G | T | Iva | I | S | D | Y | S | I | Aib |
| 299 | Me | Y | Aib | E | G | T | Iva | I | S | D | Y | S | I | Aib |
| 300 | Me | Y | Aib | E | G | T | Iva | I | S | D | Y | S | I | Aib |
| 301 | Me | Y | Aib | E | G | T | Iva | I | S | D | Y | S | I | Aib |
| 302 | Me | Y | Aib | E | G | T | Iva | I | S | D | Y | S | I | Aib |
| 303 | Me | Y | Aib | E | G | T | Iva | I | S | D | Y | S | I | Aib |

FIG. 9E

| | | | Amino acid | | | | | |
|---|---|---|---|---|---|---|---|---|
| 14 | 15 | 16 | 17 | 18 | 19 | 20 | 21 | 22 |
| L | D | R | Aib | A | Q | Aib | N | F |
| L | D | R | K(PEG(2)-dodec) | H | Q | Q | D | F |
| L | D | R | K(PEG(2)-Pal) | H | Q | Q | D | F |
| L | D | R | K(Eda-PEG(2)-) | H | Q | Q | D | F |
| L | D | R | K(-PEG3-PEG3-isoGlu-Eda) | A | Q | Aib | N | F |
| L | D | R | Aib | A | Q | Aib | N | F |
| L | D | R | K(-PEG3-PEG3-isoGlu-Eda) | H | Q | Q | D | F |
| L | D | R | I | H | Q | Q | D | F |
| L | D | R | K(PEG(2)-dodec) | H | Q | Aib | N | F |
| L | D | R | K(PEG(2)-Pal) | H | Q | Aib | N | F |
| L | D | R | K(Eda-PEG(2)-) | H | Q | Aib | N | F |
| L | D | R | Aib | H | Q | Aib | N | F |
| L | D | R | K(Ac-) | H | Q | Aib | N | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Aib | A | Q | Aib | N | F |
| L | D | R | Aib | A | Q | Aib | N | F |
| L | D | R | Aib | A | Q | Aib | N | F |
| L | D | R | K(Eda-GGGG-) | A | Q | Aib | N | F |
| L | D | R | K(Eicosanoyl-PEG(2)-) | A | Q | Aib | N | F |
| L | D | R | K(Eda-PEG(2)-) | A | Q | Aib | N | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Aib | A | Q | Aib | N | F |
| L | D | R | Aib | H | Q | Aib | N | F |
| L | D | R | Aib | A | Q | Aib | N | F |
| L | D | R | K(Eda-PEG(2)-) | A | Q | Aib | N | F |
| L | D | R | K(Eda-PEG(2)-) | H | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | E | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | K(Eda-PEG(2)-) | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | K(Eda-PEG(2)-) | A | Q | Aib | E | F |
| L | D | R | K(Eda-GGGG-) | A | Q | Aib | E | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| K(Eda-PEG(2)-) | D | R | Aib | A | Q | Aib | N | F |
| L | K(Eda-PEG(2)-) | R | Aib | A | Q | Aib | N | F |
| L | D | K(Eda-PEG(2)-) | Aib | A | Q | Aib | N | F |
| L | D | R | Aib | K(Eda-PEG(2)-) | Q | Aib | N | F |
| L | D | R | Aib | A | K(Eda-PEG(2)-) | Aib | N | F |
| L | D | R | Aib | A | Q | K(Eda-PEG(2)-) | N | F |
| L | D | R | Aib | A | Q | Aib | K(Eda-PEG(2)-) | F |
| L | D | R | Aib | A | Q | Aib | N | K(Eda-PEG(2)-) |
| L | D | R | Aib | A | Q | Aib | N | F |
| L | D | R | Aib | A | Q | Aib | N | F |
| L | D | R | Aib | A | Q | Aib | N | F |

FIG. 9F

| 23 | 24 | 25 | 26 | 27 | 28 | 29 | 30 | 31 | 32 | 33 | 34 | 35 | 36 | 37 | 38 | 39 | 40 | C | SEQ ID # |
|---|---|---|---|---|---|---|---|---|---|---|---|---|---|---|---|---|---|---|---|
| V | N | W | Iva | L | A | Q | R | P | S | S | G | A | P | P | P | S |  | NH2 | 244 |
| V | N | W | L | L | A | Q | R | P | S | S | G | A | P | P | P | S |  | NH2 | 245 |
| V | N | W | L | L | A | Q | R | P | S | S | G | A | P | P | P | S |  | NH2 | 246 |
| V | N | W | L | L | A | Q | R | P | S | S | G | A | P | P | P | S |  | NH2 | 247 |
| V | N | W | Iva | L | A | Q | R | P | S | S | G | A | P | P | P | S |  | NH2 | 248 |
| V | N | W | Iva | L | A | Q | R | P | S | S | G | A | P | P | P | S |  | NH2 | 249 |
| V | N | W | L | L | A | Q | R | P | S | S | G | A | P | P | P | S |  | NH2 | 250 |
| V | N | W | L | L | A | Q | R | P | S | S | G | A | P | P | P | S |  | NH2 | 251 |
| V | N | W | Iva | L | A | Q | R | P | S | S | G | A | P | P | P | S |  | NH2 | 252 |
| V | N | W | Iva | L | A | Q | R | P | S | S | G | A | P | P | P | S |  | NH2 | 253 |
| V | N | W | Iva | L | A | Q | R | P | S | S | G | A | P | P | P | S |  | NH2 | 254 |
| V | N | W | Iva | L | A | Q | R | P | S | S | G | A | P | P | P | S |  | NH2 | 255 |
| V | N | W | Iva | L | A | Q | R | P | S | S | G | A | P | P | P | S |  | NH2 | 256 |
| V | R | W | L | L | R | G | G | P | S | S | G | A | P | P | P | S |  | NH2 | 257 |
| V | R | W | L | L | R | G | G | P | S | S | G | A | P | P | P | S |  | NH2 | 258 |
| V | R | W | L | L | R | G | G | P | S | S | G | A | P | P | P | S |  | NH2 | 259 |
| V | K(Ac) | W | L | L | R | G | G | P | S | S | G | A | P | P | P | S |  | NH2 | 260 |
| V | K(Ac) | W | L | L | R | G | G | P | S | S | G | A | P | P | P | S |  | NH2 | 261 |
| V | K(Ac) | W | L | L | R | G | G | P | S | S | G | A | P | P | P | S |  | NH2 | 262 |
| V | N | W | Iva | L | A | Q | R | P | S | S | G | A | P | P | P | S |  | NH2 | 263 |
| V | N | W | Iva | L | A | Q | R | P | S | S | G | A | P | P | P | S |  | NH2 | 264 |
| V | N | W | Iva | L | A | Q | R | P | S | S | G | A | P | P | P | S |  | NH2 | 265 |
| V | N | W | Iva | L | A | Q | R | P | S | S | G | A | P | P | P | S |  | NH2 | 266 |
| V | N | W | Iva | L | A | Q | R | P | S | S | G | A | P | P | P | S |  | NH2 | 267 |
| V | N | W | Iva | L | A | Q | R | P | S | S | G | A | P | P | P | S |  | NH2 | 268 |
| V | R | W | L | L | A | Q | R |  |  |  |  |  |  |  |  |  |  | NH2 | 269 |
| V | R | W | L | L | A | Q | R |  |  |  |  |  |  |  |  |  |  | NH2 | 270 |
| V | R | W | L | L | A | Q | R |  |  |  |  |  |  |  |  |  |  | NH2 | 271 |
| V | K(Ac) | W | L | L | A | Q | R |  |  |  |  |  |  |  |  |  |  | NH2 | 272 |
| V | K(Ac) | W | L | L | A | Q | R |  |  |  |  |  |  |  |  |  |  | NH2 | 273 |
| V | K(Ac) | W | L | L | A | Q | R |  |  |  |  |  |  |  |  |  |  | NH2 | 274 |
| V | N | W | Iva | L | A | Q | R |  |  |  |  |  |  |  |  |  |  | NH2 | 275 |
| V | N | W | Iva | L | A | Q | R |  |  |  |  |  |  |  |  |  |  | NH2 | 276 |
| V | N | W | Iva | L | A | Q | R |  |  |  |  |  |  |  |  |  |  | NH2 | 277 |
| V | N | W | Iva | L | A | Q | R |  |  |  |  |  |  |  |  |  |  | NH2 | 278 |
| V | N | W | Iva | L | A | Q | R |  |  |  |  |  |  |  |  |  |  | NH2 | 279 |
| V | N | W | Iva | L | A | Q | R | P | S | S | G | A | P | P | P | S | E | NH2 | 280 |
| V | D | W | Iva | L | A | Q | R | P | S | S | G | A | P | P | P | S |  | NH2 | 281 |
| V | E | W | Iva | L | A | Q | R | P | S | S | G | A | P | P | P | S |  | NH2 | 282 |
| V | N | W | Iva | L | A | Q | R | P | S | S | G | A | P | P | P | S |  | NH2 | 283 |
| V | N | W | Iva | L | A | Q | R | P | S | S | G | A | P | P | P | S |  | NH2 | 284 |
| V | N | W | Iva | L | A | Q | R | P | S | S | G | A | P | P | P | S |  | NH2 | 285 |
| V | N | W | Iva | L | A | Q | R | P | S | S | G | A | P | P | P | S |  | NH2 | 286 |
| V | N | W | Iva | L | A | Q | R | P | S | S | G | A | P | P | P | S |  | NH2 | 287 |
| V | N | W | Iva | L | A | Q | R | P | S | S | G | A | P | P | P | S | E | NH2 | 288 |
| V | N | W | Iva | L | A | Q | R | P | S | S | G | A | P | P | P | S | E | NH2 | 289 |
| V | N | W | Iva | L | A | Q | R | P | S | S | G | A | P | P | P | S | E | NH2 | 290 |
| V | N | W | Iva | L | A | Q | R | P | S | S | G | A | P | P | P | S | E | NH2 | 291 |
| V | N | W | Iva | L | A | Q | R | P | S | S | G | A | P | P | P | S | E | NH2 | 292 |
| V | N | W | Iva | L | A | Q | R | P | S | S | G | A | P | P | P | S |  | NH2 | 293 |
| V | N | W | Iva | L | A | Q | R | P | S | S | G | A | P | P | P | S |  | NH2 | 294 |
| V | N | W | Iva | L | A | Q | R | P | S | S | G | A | P | P | P | S |  | NH2 | 295 |
| V | N | W | Iva | L | A | Q | R | P | S | S | G | A | P | P | P | S |  | NH2 | 296 |
| V | N | W | Iva | L | A | Q | R | P | S | S | G | A | P | P | P | S |  | NH2 | 297 |
| V | K(Ac) | W | L | L | R | G | G | P | S | S | G | A | P | P | P | S |  | NH2 | 298 |
| V | K(Ac) | W | L | L | R | G | G | P | S | S | G | A | P | P | P | S |  | NH2 | 299 |
| V | N | W | Iva | L | A | Q | R | P | S | S | G | A | P | P | P | S |  | NH2 | 300 |
| V | N | W | Iva | L | A | Q | R | P | S | S | G | A | P | P | P | S |  | NH2 | 301 |
| V | N | W | Iva | L | A | Q | R | P | S | S | G | A | P | P | P | S |  | NH2 | 302 |
| V | N | W | Iva | L | A | Q | R | P | S | S | G | A | P | P | P | S |  | NH2 | 303 |
| V | N | W | Iva | L | A | Q | R | P | S | S | G | A | P | P | P | S |  | NH2 | 304 |
| V | N | W | Iva | L | A | Q | R | P | S | S | G | A | P | P | P | S |  | NH2 | 305 |
| V | N | W | Iva | L | A | Q | R | P | S | S | G | A | P | P | P | S |  | NH2 | 306 |
| V | N | W | Iva | L | A | Q | R | P | S | S | G | A | P | P | P | S |  | NH2 | 307 |
| V | N | W | Iva | L | A | Q | R | P | S | S | G | A | P | P | P | S |  | NH2 | 308 |
| V | N | W | Iva | L | A | Q | R | P | S | S | G | A | P | P | P | S |  | NH2 | 309 |
| V | N | W | Iva | L | A | Q | R | P | S | S | G | A | P | P | P | S |  | NH2 | 31 |
| V | N | W | Iva | L | A | Q | R | P | S | S | G | A | P | P | P | S |  | NH2 | 311 |
| V | N | W | Iva | L | A | Q | R | P | S | S | G | A | P | P | P | S |  | NH2 | 312 |
| K(Eda-PEG(2)-) | N | W | Iva | L | A | Q | R | P | S | S | G | A | P | P | P | S |  | NH2 | 313 |
| V | K(Eda-PEG(2)-) | W | Iva | L | A | Q | R | P | S | S | G | A | P | P | P | S |  | NH2 | 314 |
| V | N | K(Eda-PEG(2)-) | Iva | L | A | Q | R | P | S | S | G | A | P | P | P | S |  | NH2 | 315 |
| V | N | W | K(Eda-PEG(2)-) | L | A | Q | R | P | S | S | G | A | P | P | P | S |  | NH2 | 316 |

FIG. 9G

| compound # | N | 1 | 2 | 3 | 4 | 5 | 6 | 7 | 8 | 9 | 10 | 11 | 12 | 13 |
|---|---|---|---|---|---|---|---|---|---|---|---|---|---|---|
| 304 | Me | Y | Aib | E | G | T | Iva | I | S | D | Y | S | I | Aib |
| 305 | Me | Y | Aib | E | G | T | Iva | I | S | D | Y | S | I | Aib |
| 306 | Me | Y | Aib | E | G | T | Iva | I | S | D | Y | S | I | Aib |
| 307 | Me | Y | Aib | E | G | T | Iva | I | S | D | Y | S | I | Aib |
| 308 | Me | Y | Aib | E | G | T | Iva | I | S | D | Y | S | I | Aib |
| 309 | Me | Y | Aib | E | G | T | Iva | I | S | D | Y | S | I | Aib |
| 310 | Me | Y | Aib | E | G | T | Iva | I | S | D | Y | S | I | Aib |
| 311 | Me | Y | Aib | E | G | T | Iva | I | S | D | Y | S | I | Aib |
| 312 | Me | Y | Aib | E | G | T | Iva | I | S | D | Y | S | I | Aib |
| 313 | Me | Y | Aib | E | G | T | Iva | I | S | D | Y | S | I | Aib |
| 314 | Me | Y | Aib | E | G | T | Iva | I | S | D | Y | S | I | Aib |
| 315 | Me | Y | Aib | E | G | T | Iva | I | S | D | Y | S | K(Eda-γGlu-) | Aib |
| 316 | Me | Y | Aib | E | G | T | Iva | I | S | D | Y | S | K(Eda-γE-PEG3-) | Aib |
| 317 | Me | Y | Aib | E | G | T | Iva | I | S | D | Y | S | K(Eda-(γE)2-PEG3-) | Aib |
| 318 | Me | Y | Aib | E | G | T | Iva | I | S | D | Y | S | K(Eda-(γGlu)2-) | Aib |
| 319 | Me | Y | Aib | E | G | T | Iva | I | S | D | Y | S | K(Eda-(γGlu)3-) | Aib |
| 320 | Me | Y | Aib | E | G | T | Iva | I | S | D | Y | S | K(Eda-γE-GGG-) | Aib |
| 321 | Me | Y | Aib | E | G | T | Iva | I | S | D | Y | S | K(Eda-GABA-GGG-) | Aib |
| 322 | Me | Y | Aib | E | G | T | Iva | I | S | D | Y | S | K(Eda-GABA-(PEG3)2-) | Aib |
| 323 | H- | Y | Aib | E | G | T | V | V | S | L | Y | S | K(Eda-PEG3-) | Aib |
| 324 | H- | Y | Aib | E | G | T | V | V | S | L | Y | S | K(Eda-PEG3-PEG3-) | Aib |
| 325 | H- | Y | Aib | E | G | T | V | V | S | L | Y | S | K(Eda-γE-PEG3-) | Aib |
| 326 | H- | Y | Aib | E | G | T | V | V | S | L | Y | S | K(Eda-γE-(PEG3)2-) | Aib |
| 327 | H- | Y | Aib | E | G | T | V | V | S | L | Y | S | K(Eda-GGG-) | Aib |
| 328 | H- | Y | Aib | E | G | T | V | V | S | L | Y | S | K(Eda-γGlu-) | Aib |
| 329 | H- | Y | Aib | E | G | T | V | V | S | L | Y | S | K(Eda-γE-GGG-) | Aib |
| 330 | H- | Y | Aib | E | G | T | V | V | S | L | Y | S | K(Eda-GGGGG-) | Aib |
| 331 | Me | Y | Aib | E | G | T | Iva | I | S | D | Y | S | K(Eda-PEG3-) | Aib |
| 332 | Me | Y | Aib | E | G | T | Iva | I | S | D | Y | S | K(Eda-(PEG3)2-) | Aib |
| 333 | Me | Y | Aib | E | G | T | Iva | I | S | D | Y | S | K(Eda-(PEG3)3-) | Aib |
| 334 | Me | Y | Aib | E | G | T | Iva | I | S | D | Y | S | K(Eda-Tra-PEG3-) | Aib |
| 335 | Me | Y | Aib | E | G | T | Iva | I | S | D | Y | S | K(Eda-εLys-PEG3-) | Aib |
| 336 | Me | Y | Aib | E | G | T | Iva | I | S | D | Y | S | K(Eda-NpipAc-PEG3-) | Aib |
| 337 | Me | Y | Aib | E | G | T | Iva | I | S | D | Y | S | K(Eda-AMBZ-PEG3-) | Aib |
| 338 | Me | Y | Aib | E | G | T | Iva | I | S | D | Y | S | K(Eda-γE-Tra-PEG3-) | Aib |
| 339 | Me | Y | Aib | E | G | T | Iva | I | S | D | Y | S | K(Eda-γE-AMBZ-PEG3-) | Aib |
| 340 | Me | Y | Aib | E | G | T | Iva | I | S | D | Y | S | I | Aib |
| 341 | Me | Y | Aib | E | G | T | Iva | I | S | D | Y | S | I | Aib |
| 342 | Me | Y | Aib | E | G | T | Iva | I | S | D | Y | S | I | Aib |
| 343 | Me | Y | Aib | E | G | T | Iva | I | S | D | Y | S | K(Oda-GGGG-) | Aib |
| 344 | Me | Y | Aib | E | G | T | Iva | I | S | D | Y | S | K(Oda-GGGGG-) | Aib |
| 345 | Me | Y | Aib | E | G | T | Iva | I | S | D | Y | S | K(Oda-γE-(PEG3)2-) | Aib |
| 346 | Me | Y | Aib | E | G | T | Iva | I | S | D | Y | S | K(Oda-PEG(2)-) | Aib |
| 347 | Me | Y | Aib | E | G | T | Iva | I | S | D | Y | S | K(Eda-GGGGGG-) | Aib |
| 348 | Me | Y | Aib | E | G | T | Iva | I | S | D | Y | S | I | Aib |
| 349 | Me | Y | Aib | E | G | T | Iva | I | S | D | Y | S | I | Aib |
| 350 | Me | Y | Aib | E | G | T | Iva | I | S | D | Y | S | I | Aib |
| 351 | Me | Y | Aib | E | G | T | Iva | I | S | D | Y | S | I | Aib |
| 352 | Me | Y | Aib | E | G | T | Iva | I | S | D | Y | S | I | Aib |
| 353 | Me | Y | Aib | E | G | T | Iva | I | S | D | Y | S | K(Eda-Tra-GGG-) | Aib |
| 354 | Me | Y | Aib | E | G | T | Iva | I | S | D | Y | S | K(Eda-G9-) | Aib |
| 355 | Me | Y | Aib | E | G | T | Iva | I | S | D | Y | S | K(Dda-GGGGG-) | Aib |
| 356 | Me | Y | Aib | E | G | T | Iva | I | S | D | Y | S | K(Eda-εLys-GGG-) | Aib |
| 357 | Me | Y | Aib | E | G | T | Iva | I | S | D | Y | S | I | Aib |
| 358 | Me | Y | Aib | E | G | T | Iva | I | S | D | Y | S | I | Aib |
| 359 | Me | Y | Aib | E | G | T | Iva | I | S | D | Y | S | I | Aib |
| 360 | Me | Y | Aib | E | G | T | Iva | I | S | D | Y | S | I | Aib |
| 361 | Me | Y | Aib | E | G | T | Iva | I | S | D | Y | S | I | Aib |
| 362 | Me | Y | Aib | E | G | T | Iva | I | S | D | Y | S | I | Aib |
| 363 | Me | Y | Aib | E | G | T | Iva | I | S | D | Y | S | K(Eda-GGGGG-) | Aib |
| 364 | Me | Y | Aib | E | G | T | Iva | I | S | D | Y | S | K(Eda-GGGGGG-) | Aib |
| 365 | Me | Y | Aib | E | G | T | Iva | I | S | D | Y | S | K(Eda-(PEG3)2-) | Aib |
| 366 | Me | Y | Aib | E | G | T | Iva | I | S | D | Y | S | K(Eda-(PEG3)3-) | Aib |
| 367 | Me | Y | Aib | E | G | T | Iva | I | S | D | Y | S | K(Eda-γE-(PEG3)2-) | Aib |
| 368 | Me | Y | Aib | E | G | T | Iva | I | S | D | Y | S | I | Aib |
| 369 | Me | Y | Aib | E | G | T | Iva | I | S | D | Y | S | I | Aib |
| 370 | Me | Y | Aib | E | G | T | Iva | I | S | D | Y | S | I | Aib |
| 371 | Me | Y | Aib | E | G | T | Iva | I | S | D | Y | S | I | Aib |
| 372 | Me | Y | Aib | E | G | T | Iva | I | S | D | Y | S | I | Aib |
| 373 | Me | Y | Aib | E | G | T | Iva | I | S | D | Y | S | I | Aib |
| 374 | Me | Y | Aib | E | G | T | Iva | I | S | D | Y | S | I | Aib |
| 375 | Me | Y | Aib | E | G | T | Iva | I | S | D | Y | S | I | Aib |
| 376 | Me | Y | Aib | E | G | T | Iva | I | S | D | Y | S | I | Aib |

FIG. 9H

| | | | Amino acid | | | | | |
|---|---|---|---|---|---|---|---|---|
| 14 | 15 | 16 | 17 | 18 | 19 | 20 | 21 | 22 |
| L | D | R | Aib | A | Q | Aib | N | F |
| L | D | R | K(Eda- - -) | A | Q | Aib | N | F |
| L | D | R | K(Eda-PEG3-) | A | Q | Aib | N | F |
| L | D | R | K(Eda-(PEG3)2-) | A | Q | Aib | N | F |
| L | D | R | K(Eda-(PEG3)3-) | A | Q | Aib | N | F |
| L | D | R | K(Eda-(PEG3)4-) | A | Q | Aib | N | F |
| L | D | R | K(Eda-(PEG3)5-) | A | Q | Aib | N | F |
| L | D | R | K(Eda-G-) | A | Q | Aib | N | F |
| L | D | R | K(Eda-GG-) | A | Q | Aib | N | F |
| L | D | R | K(Eda-GGG-) | A | Q | Aib | N | F |
| L | D | R | K(Eda-GGGG-) | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Q | A | Q | Aib | E | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| K(Eda-GGGG-) | D | R | Aib | A | Q | Aib | N | F |
| K(Eda-GGGGG-) | D | R | Aib | A | Q | Aib | N | F |
| K(Eda-GGGGGG-) | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | K(Oda-GGGG-) | A | Q | Aib | N | F |
| L | D | R | K(Oda-GGGGG-) | A | Q | Aib | N | F |
| L | D | R | K(Oda-yE-(PEG3)2-) | A | Q | Aib | N | F |
| L | D | R | K(Oda-PEG(2)-) | A | Q | Aib | N | F |
| L | D | R | K(Eda-GGGGG-) | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | K(Eda-yE-GGG-) | A | Q | Aib | N | F |
| L | D | R | K(Eda-GABA-GGG-) | A | Q | Aib | N | F |
| L | D | R | K(Eda-rLys-GGG-) | A | Q | Aib | N | F |
| L | D | R | K(Eda-Tra-GGG-) | A | Q | Aib | N | F |
| L | D | R | K(Dda-GGGGG-) | A | Q | Aib | N | F |
| L | D | R | K(Eda-G9-) | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| K(Eda-GGGG-) | D | R | Aib | A | Q | Aib | N | F |
| K(Eda-GGGGG-) | D | R | Aib | A | Q | Aib | N | F |
| K(Eda-GGGGGG-) | D | R | Aib | A | Q | Aib | N | F |
| K(Eda-(PEG3)2-) | D | R | Aib | A | Q | Aib | N | F |
| K(Eda-yE-(PEG3)2-) | D | R | Aib | A | Q | Aib | N | F |
| K(Eda-(PEG3)3-) | D | R | Aib | A | Q | Aib | N | F |
| L | D | R | K(Eda-GGGG-) | A | Q | Aib | N | F |
| L | D | R | K(Eda-GGGGG-) | A | Q | Aib | N | F |
| L | D | R | K(Eda-GGGGGG-) | A | Q | Aib | N | F |

FIG. 9I

| 23 | 24 | 25 | 26 | 27 | 28 | 29 | 30 | 31 | 32 | 33 | 34 | 35 | 36 | 37 | 38 | 39 | 40 | C | SEQ ID # |
|---|---|---|---|---|---|---|---|---|---|---|---|---|---|---|---|---|---|---|---|
| V | N | W | Iva | K(Eda-PEG(2)-) | A | Q | R | P | S | S | G | A | P | P | P | S | | NH2 | 317 |
| V | N | W | Iva | L | A | Q | R | P | S | S | G | A | P | P | P | S | | NH2 | 318 |
| V | N | W | Iva | L | A | Q | R | P | S | S | G | A | P | P | P | S | | NH2 | 319 |
| V | N | W | Iva | L | A | Q | R | P | S | S | G | A | P | P | P | S | | NH2 | 320 |
| V | N | W | Iva | L | A | Q | R | P | S | S | G | A | P | P | P | S | | NH2 | 321 |
| V | N | W | Iva | L | A | Q | R | P | S | S | G | A | P | P | P | S | | NH2 | 322 |
| V | N | W | Iva | L | A | Q | R | P | S | S | G | A | P | P | P | S | | NH2 | 323 |
| V | N | W | Iva | L | A | Q | R | P | S | S | G | A | P | P | P | S | | NH2 | 324 |
| V | N | W | Iva | L | A | Q | R | P | S | S | G | A | P | P | P | S | | NH2 | 325 |
| V | N | W | Iva | L | A | Q | R | P | S | S | G | A | P | P | P | S | | NH2 | 326 |
| V | N | W | Iva | L | A | Q | R | P | S | S | G | A | P | P | P | S | | NH2 | 327 |
| V | N | W | Iva | L | A | Q | R | P | S | S | G | A | P | P | P | S | | NH2 | 328 |
| V | N | W | Iva | L | A | Q | R | P | S | S | G | A | P | P | P | S | | NH2 | 329 |
| V | N | W | Iva | L | A | Q | R | P | S | S | G | A | P | P | P | S | | NH2 | 330 |
| V | N | W | Iva | L | A | Q | R | P | S | S | G | A | P | P | P | S | | NH2 | 331 |
| V | N | W | Iva | L | A | Q | R | P | S | S | G | A | P | P | P | S | | NH2 | 332 |
| V | N | W | Iva | L | A | Q | R | P | S | S | G | A | P | P | P | S | | NH2 | 333 |
| V | N | W | Iva | L | A | Q | R | P | S | S | G | A | P | P | P | S | | NH2 | 334 |
| V | N | W | Iva | L | A | Q | R | P | S | S | G | A | P | P | P | S | | NH2 | 335 |
| V | K(Ac) | W | L | L | R | G | G | P | S | S | G | A | P | P | P | S | | NH2 | 336 |
| V | K(Ac) | W | L | L | R | G | G | P | S | S | G | A | P | P | P | S | | NH2 | 337 |
| V | K(Ac) | W | L | L | R | G | G | P | S | S | G | A | P | P | P | S | | NH2 | 338 |
| V | K(Ac) | W | L | L | R | G | G | P | S | S | G | A | P | P | P | S | | NH2 | 339 |
| V | K(Ac) | W | L | L | R | G | G | P | S | S | G | A | P | P | P | S | | NH2 | 340 |
| V | K(Ac) | W | L | L | R | G | G | P | S | S | G | A | P | P | P | S | | NH2 | 341 |
| V | K(Ac) | W | L | L | R | G | G | P | S | S | G | A | P | P | P | S | | NH2 | 342 |
| V | K(Ac) | W | L | L | R | G | G | P | S | S | G | A | P | P | P | S | | NH2 | 343 |
| V | N | W | Iva | L | A | Q | R | P | S | S | G | A | P | P | P | S | | NH2 | 344 |
| V | N | W | Iva | L | A | Q | R | P | S | S | G | A | P | P | P | S | | NH2 | 345 |
| V | N | W | Iva | L | A | Q | R | P | S | S | G | A | P | P | P | S | | NH2 | 346 |
| V | N | W | Iva | L | A | Q | R | P | S | S | G | A | P | P | P | S | | NH2 | 347 |
| V | N | W | Iva | L | A | Q | R | P | S | S | G | A | P | P | P | S | | NH2 | 348 |
| V | N | W | Iva | L | A | Q | R | P | S | S | G | A | P | P | P | S | | NH2 | 349 |
| V | N | W | Iva | L | A | Q | R | P | S | S | G | A | P | P | P | S | | NH2 | 350 |
| V | N | W | Iva | L | A | Q | R | P | S | S | G | A | P | P | P | S | | NH2 | 351 |
| V | N | W | Iva | L | A | Q | R | P | S | S | G | A | P | P | P | S | | NH2 | 352 |
| V | N | W | Iva | L | A | Q | R | P | S | S | G | A | P | P | P | S | | NH2 | 353 |
| V | N | W | Iva | L | A | Q | R | P | S | S | G | A | P | P | P | S | | NH2 | 354 |
| V | N | W | Iva | L | A | Q | R | P | S | S | G | A | P | P | P | S | | NH2 | 355 |
| V | N | W | Iva | L | A | Q | R | P | S | S | G | A | P | P | P | S | | NH2 | 356 |
| V | N | W | Iva | L | A | Q | R | P | S | S | G | A | P | P | P | S | | NH2 | 357 |
| V | N | W | Iva | L | A | Q | R | P | S | S | G | A | P | P | P | S | | NH2 | 358 |
| V | N | W | Iva | L | A | Q | R | P | S | S | G | A | P | P | P | S | | NH2 | 359 |
| V | N | W | Iva | L | A | Q | R | P | S | S | G | A | P | P | P | S | | NH2 | 360 |
| V | N | W | Iva | L | A | Q | R | P | S | S | G | A | P | P | P | S | | NH2 | 361 |
| V | N | W | Iva | L | A | Q | R | P | S | S | G | A | P | P | P | S | | NH2 | 362 |
| V | N | W | Iva | L | A | Q | R | P | S | S | G | A | P | P | P | S | | NH2 | 363 |
| V | N | W | Iva | L | A | Q | R | P | S | S | G | A | P | P | P | S | | NH2 | 364 |
| V | N | W | Iva | L | A | Q | R | P | S | S | G | A | P | P | P | S | | NH2 | 365 |
| V | N | W | Iva | L | A | Q | R | P | S | S | G | A | P | P | P | S | | NH2 | 366 |
| V | N | W | Iva | L | A | Q | R | P | S | S | G | A | P | P | P | S | | NH2 | 367 |
| V | N | W | Iva | L | A | Q | R | P | S | S | G | A | P | P | P | S | | NH2 | 368 |
| V | N | W | Iva | L | A | Q | R | P | S | S | G | A | P | P | P | S | | NH2 | 369 |
| V | N | W | Iva | L | A | Q | R | P | S | S | G | A | P | P | P | S | | NH2 | 370 |
| V | N | W | Iva | L | A | Q | R | P | S | S | G | A | P | P | P | S | | NH2 | 371 |
| V | N | W | Iva | L | A | Q | R | P | S | S | G | A | P | P | P | S | | NH2 | 372 |
| V | N | W | Iva | L | A | Q | R | P | S | S | G | A | P | P | P | S | | NH2 | 373 |
| V | N | W | Iva | L | A | Q | R | P | S | S | G | A | P | P | P | S | | NH2 | 374 |
| V | N | W | Iva | L | A | Q | R | P | S | S | G | A | P | P | P | S | | NH2 | 375 |
| V | N | W | Iva | L | A | Q | R | | | | | | | | | | | NH2 | 376 |
| V | N | W | Iva | L | A | Q | R | | | | | | | | | | | NH2 | 377 |
| V | N | W | Iva | L | A | Q | R | | | | | | | | | | | NH2 | 378 |
| V | N | W | Iva | L | A | Q | R | | | | | | | | | | | NH2 | 379 |
| V | N | W | Iva | L | A | Q | R | | | | | | | | | | | NH2 | 380 |
| V | N | W | Iva | L | A | Q | R | | | | | | | | | | | NH2 | 381 |
| V | N | W | Iva | L | A | Q | R | | | | | | | | | | | NH2 | 382 |
| V | N | W | Iva | L | A | Q | R | | | | | | | | | | | NH2 | 383 |
| V | N | W | Iva | L | A | Q | R | | | | | | | | | | | NH2 | 384 |
| V | N | W | Iva | L | A | Q | R | | | | | | | | | | | NH2 | 385 |
| V | N | W | Iva | L | A | Q | R | | | | | | | | | | | NH2 | 386 |
| V | N | W | Iva | L | A | Q | R | | | | | | | | | | | NH2 | 387 |
| V | N | W | Iva | L | A | Q | R | | | | | | | | | | | NH2 | 388 |
| V | N | W | Iva | L | A | Q | R | | | | | | | | | | | NH2 | 389 |

FIG. 9J

| compond # | N | 1 | 2 | 3 | 4 | 5 | 6 | 7 | 8 | 9 | 10 | 11 | 12 | 13 |
|---|---|---|---|---|---|---|---|---|---|---|---|---|---|---|
| 377 | Me | Y | Aib | E | G | T | Iva | I | S | D | Y | S | I | Aib |
| 378 | Me | Y | Aib | E | G | T | Iva | I | S | D | Y | S | I | Aib |
| 379 | Me | Y | Aib | E | G | T | Iva | I | S | D | Y | S | I | Aib |
| 380 | Me | Y | Aib | E | G | T | Iva | I | S | D | Y | S | I | Aib |
| 381 | Me | Y | Aib | E | G | T | F | I | S | D | Y | S | K(Eda-PEG(2)-) | A |
| 382 | Me | Y | Aib | E | G | T | F | I | S | D | Y | S | K(Eda-GGGGG-) | A |
| 383 | Me | Y | Aib | E | G | T | F | I | S | D | Y | S | I | A |
| 384 | Me | Y | Aib | E | G | T | F | I | S | D | Y | S | I | A |
| 385 | Me | Y | Aib | E | G | T | F | I | S | D | Y | S | I | A |
| 386 | Me | Y | Aib | E | G | T | F | I | S | D | Y | S | I | A |
| 387 | Me | Y | Aib | E | G | T | F | I | S | D | Y | S | K(Eda-PEG(2)-) | A |
| 388 | Me | Y | Aib | E | G | T | F | I | S | D | Y | S | K(Eda-GGGGG-) | A |
| 389 | Me | Y | Aib | E | G | T | F | I | S | D | Y | S | I | A |
| 390 | Me | Y | Aib | E | G | T | F | I | S | D | Y | S | I | A |
| 391 | Me | Y | Aib | E | G | T | F | I | S | D | Y | S | I | A |
| 392 | Me | Y | Aib | E | G | T | F | I | S | D | Y | S | I | A |
| 393 | Me | Y | Aib | E | G | T | Iva | I | S | D | Y | S | K(Eda-GGGGG-) | Aib |
| 394 | Me | Y | Aib | E | G | T | Iva | I | S | D | Y | S | K(Eda-PEG(2)-) | Aib |
| 395 | Me | Y | Aib | E | G | T | Iva | I | S | D | Y | S | I | Aib |
| 396 | Me | Y | Aib | E | G | T | Iva | I | S | D | Y | S | I | Aib |
| 397 | Ac | Y | Aib | E | G | T | Iva | I | S | D | Y | S | K(Eda-GGGGG-) | Aib |
| 398 | Ac | Y | Aib | E | G | T | Iva | I | S | D | Y | S | K(Eda-PEG(2)-) | Aib |
| 399 | Ac | Y | Aib | E | G | T | Iva | I | S | D | Y | S | I | Aib |
| 400 | Ac | Y | Aib | E | G | T | Iva | I | S | D | Y | S | I | Aib |
| 401 | Me | Y | Aib | E | G | T | F | I | S | D | Y | S | K(Eda-GGGGG-) | A |
| 402 | Me | Y | Aib | E | G | T | F | I | S | D | Y | S | K(Eda-PEG(2)-) | A |
| 403 | Me | Y | Aib | E | G | T | F | I | S | D | Y | S | I | A |
| 404 | Me | Y | Aib | E | G | T | F | I | S | D | Y | S | I | A |
| 405 | Ac | Y | Aib | E | G | T | F | I | S | D | Y | S | K(Eda-GGGGG-) | A |
| 406 | Ac | Y | Aib | E | G | T | F | I | S | D | Y | S | K(Eda-PEG(2)-) | A |
| 407 | Ac | Y | Aib | E | G | T | F | I | S | D | Y | S | I | A |
| 408 | Ac | Y | Aib | E | G | T | F | I | S | D | Y | S | I | A |
| 409 | Ac | Y | Aib | E | G | T | Iva | I | S | D | Y | S | K(Eda-GGGGG-) | Aib |
| 410 | Ac | Y | Aib | E | G | T | Iva | I | S | D | Y | S | I | Aib |
| 411 | Ac | Y | Aib | E | G | T | Iva | I | S | D | Y | S | K(Eda-GGGGG-) | Aib |
| 412 | Ac | Y | Aib | E | G | T | Iva | I | S | D | Y | S | I | Aib |
| 413 | Me | Y | Aib | E | G | T | Iva | I | S | D | Y | S | I | Aib |
| 414 | Me | Y | Aib | E | G | T | Iva | I | S | D | Y | S | I | Aib |
| 415 | Me | Y | Aib | E | G | T | Iva | I | S | D | Y | S | I | Aib |
| 416 | Me | Y | Aib | E | G | T | Iva | I | S | D | Y | S | I | Aib |
| 417 | Me | Y | Aib | E | G | T | Iva | I | S | D | Y | S | I | Aib |
| 418 | Ac | Y | Aib | E | G | T | Iva | I | S | D | Y | S | I | Aib |
| 419 | Ac | Y | Aib | E | G | T | Iva | I | S | D | Y | S | I | Aib |
| 420 | Me | Y | Aib | E | G | T | Iva | I | S | D | Y | S | I | Aib |
| 421 | Me | Y | Aib | E | G | T | Iva | I | S | D | Y | S | I | Aib |
| 422 | Me | Y | Aib | E | G | T | Iva | I | S | D | Y | S | K(Eda-GGGGG-) | Aib |
| 423 | Me | Y | Aib | E | G | T | Iva | I | S | D | Y | S | K(Eda-PEG(2)-) | Aib |
| 424 | Me | Y | Aib | E | G | T | Iva | I | S | D | Y | S | I | Aib |
| 425 | Me | Y | Aib | E | G | T | Iva | I | S | D | Y | S | I | Aib |
| 426 | Me | Y | Aib | E | G | T | Iva | I | S | D | Y | S | I | Aib |
| 427 | Me | Y | Aib | E | G | T | Iva | I | S | D | Y | S | I | Aib |
| 428 | Me | Y | Aib | E | G | T | Iva | I | S | D | Y | S | I | Aib |
| 429 | Me | Y | Aib | E | G | T | Iva | I | S | D | Y | S | I | Aib |
| 430 | Me | Y | Aib | E | G | T | Iva | I | S | D | Y | S | I | Aib |
| 431 | Me | Y | Aib | E | G | T | Iva | I | S | D | Y | S | I | Aib |
| 432 | Me | Y | Aib | E | G | T | Iva | I | S | D | Y | S | I | Aib |
| 433 | Me | Y | Aib | E | G | T | Iva | I | S | D | Y | S | I | Aib |
| 434 | Me | Y | Aib | E | G | T | Iva | I | S | D | Y | S | I | Aib |
| 435 | Ac | Y | Aib | E | G | T | Iva | I | S | D | Y | S | I | Aib |
| 436 | Ac | Y | Aib | E | G | T | Iva | I | S | D | Y | S | I | Aib |
| 437 | Ac | Y | Aib | E | G | T | Iva | I | S | D | Y | S | I | Aib |
| 438 | Ac | Y | Aib | E | G | T | Iva | I | S | D | Y | S | I | Aib |
| 439 | Me | Y | Aib | E | G | T | Iva | I | S | D | Y | S | I | Aib |
| 440 | Me | Y | Aib | E | G | T | Iva | I | S | D | Y | S | I | Aib |
| 441 | Me | Y | Aib | E | G | T | Iva | I | S | D | Y | S | I | Aib |
| 442 | Me | Y | Aib | E | G | T | Iva | I | S | D | Y | S | I | Aib |
| 443 | Me | Y | Aib | E | G | T | Iva | I | S | D | Y | S | I | Aib |
| 444 | Me | Y | Aib | E | G | T | Iva | I | S | D | Y | S | I | Aib |
| 445 | Me | Y | Aib | E | G | T | Iva | I | S | D | Y | S | I | Aib |
| 446 | Me | Y | Aib | E | G | T | Iva | I | S | D | Y | S | I | Aib |
| 447 | Me | Y | Aib | E | G | T | Iva | I | S | D | Y | S | I | Aib |
| 448 | Me | Y | Aib | E | G | T | Iva | I | S | D | Y | S | I | Aib |
| 449 | Me | Y | Aib | E | G | T | Iva | I | S | D | Y | S | I | Aib |

FIG. 9K

| | | | Amino acid | | | | | |
|---|---|---|---|---|---|---|---|---|
| 14 | 15 | 16 | 17 | 18 | 19 | 20 | 21 | 22 |
| L | D | R | K(Eda-(PEG3)2-) | A | Q | Aib | N | F |
| L | D | R | K(Eda-γE-(PEG3)2-) | A | Q | Aib | N | F |
| L | D | R | K(Eda-(PEG3)3-) | A | Q | Aib | N | F |
| K(Eda-PEG(2)-) | D | R | Aib | A | Q | Aib | N | F |
| L | D | R | I | A | Q | Q | N | F |
| L | D | R | I | A | Q | Q | N | F |
| K(Eda-PEG(2)-) | D | R | I | A | Q | Q | N | F |
| K(Eda-GGGGG-) | D | R | I | A | Q | Q | N | F |
| L | D | R | K(Eda-PEG(2)-) | A | Q | Q | N | F |
| L | D | R | K(Eda-GGGGG-) | A | Q | Q | N | F |
| L | D | R | I | A | Q | Q | N | F |
| L | D | R | I | A | Q | Q | N | F |
| K(Eda-PEG(2)-) | D | R | I | A | Q | Q | N | F |
| K(Eda-GGGGG-) | D | R | I | A | Q | Q | N | F |
| L | D | R | K(Eda-PEG(2)-) | A | Q | Q | N | F |
| L | D | R | K(Eda-GGGGG-) | A | Q | Q | N | F |
| L | D | R | Aib | A | Q | Aib | N | F |
| L | D | R | Aib | A | Q | Aib | N | F |
| L | D | R | K(Eda-GGGGG-) | A | Q | Aib | N | F |
| L | D | R | K(Eda-PEG(2)-) | A | Q | Aib | N | F |
| L | D | R | Aib | A | Q | Aib | N | F |
| L | D | R | Aib | A | Q | Aib | N | F |
| L | D | R | K(Eda-GGGGG-) | A | Q | Aib | N | F |
| L | D | R | K(Eda-PEG(2)-) | A | Q | Aib | N | F |
| L | D | R | I | A | Q | Q | N | F |
| L | D | R | I | A | Q | Q | N | F |
| L | D | R | K(Eda-GGGGG-) | A | Q | Q | N | F |
| L | D | R | K(Eda-PEG(2)-) | A | Q | Q | N | F |
| L | D | R | I | A | Q | Q | N | F |
| L | D | R | I | A | Q | Q | N | F |
| L | D | R | K(Eda-GGGGG-) | A | Q | Q | N | F |
| L | D | R | K(Eda-PEG(2)-) | A | Q | Q | N | F |
| L | D | R | Aib | A | Q | Aib | N | F |
| L | D | R | K(Eda-GGGGG-) | A | Q | Aib | N | F |
| L | D | R | Aib | A | Q | Aib | N | F |
| L | D | R | K(Eda-PEG(2)-) | A | Q | Aib | N | F |
| L | D | R | K(Eda-GGGGG-) | A | Q | Aib | N | F |
| K(Oda-PEG(2)-) | D | R | Aib | A | Q | Aib | N | F |
| K(Oda-GGGGG-) | D | R | Aib | A | Q | Aib | N | F |
| K(Eda-PEG(2)-) | D | R | Aib | A | Q | Aib | N | F |
| K(Eda-GGGGG-) | D | R | Aib | A | Q | Aib | N | F |
| K(Eda-PEG(2)-) | D | R | Aib | A | Q | Aib | N | F |
| K(Eda-GGGGG-) | D | R | Aib | A | Q | Aib | N | F |
| K(Oda-GGGGG-) | D | R | Aib | A | Q | Aib | N | F |
| K(Oda-GGGGG-) | D | R | Aib | A | Q | Aib | N | F |
| L | D | R | Aib | A | Q | Aib | N | F |
| L | D | R | Aib | A | Q | Aib | N | F |
| K(Eda-GGGGG-) | D | R | Aib | A | Q | Aib | N | F |
| K(Eda-PEG(2)-) | D | R | Aib | A | Q | Aib | N | F |
| L | D | R | K(Eda-GGGGG-) | A | Q | Aib | N | F |
| L | D | R | K(Eda-PEG(2)-) | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| L | D | R | Aib | A | Q | Aib | N | F |
| K(Eda-GGGGG-) | D | R | Aib | A | Q | Aib | N | F |
| K(Eda-GGGGGG-) | D | R | Aib | A | Q | Aib | N | F |
| L | D | R | K(Eda-GGGGGG-) | A | Q | Aib | N | F |
| K(Eda-GGGGG-) | D | R | Aib | A | Q | Aib | N | F |
| K(Eda-GGGGGG-) | D | R | Aib | A | Q | Aib | N | F |
| K(Eda-GGGGG-) | D | R | Aib | A | Q | Aib | N | F |
| K(Eda-GGGGGG-) | D | R | Aib | A | Q | Aib | N | F |
| K(Oda-GGGGGG-) | D | R | Aib | A | Q | Aib | N | F |
| K(Oda-GGGGG-) | D | R | Aib | A | Q | Aib | N | F |
| K(Dda-GGGGG-) | D | R | Aib | A | Q | Aib | N | F |
| K(Oda-GGGGGG-) | D | R | Aib | A | Q | Aib | N | F |
| K(Dda-GGGGGG-) | D | R | Aib | A | Q | Aib | N | F |
| K(Heda-GGGGG-) | D | R | Aib | A | Q | Aib | N | F |
| K(Teda-GGGGG-) | D | R | Aib | A | Q | Aib | N | F |
| K(Doda-GGGGG-) | D | R | Aib | A | Q | Aib | N | F |
| K(Trda-GGGG-) | D | R | Aib | A | Q | Aib | N | F |
| K(Trda-GGGGG-) | D | R | Aib | A | Q | Aib | N | F |

FIG. 9L

| 23 | 24 | 25 | 26 | 27 | 28 | 29 | 30 | 31 | 32 | 33 | 34 | 35 | 36 | 37 | 38 | 39 | 40 | C | SEQ ID # |
|---|---|---|---|---|---|---|---|---|---|---|---|---|---|---|---|---|---|---|---|
| V | N | W | Iva | L | A | Q | R |   |   |   |   |   |   |   |   |   |   | NH2 | 390 |
| V | N | W | Iva | L | A | Q | R |   |   |   |   |   |   |   |   |   |   | NH2 | 391 |
| V | N | W | Iva | L | A | Q | R |   |   |   |   |   |   |   |   |   |   | NH2 | 392 |
| V | N | W | Iva | L | A | Q | R |   |   |   |   |   |   |   |   |   |   | NH2 | 393 |
| V | N | W | Iva | L | A | Q | R | P | S | S | G | A | P | P | P | S |   | NH2 | 394 |
| V | N | W | Iva | L | A | Q | R | P | S | S | G | A | P | P | P | S |   | NH2 | 395 |
| V | N | W | Iva | L | A | Q | R | P | S | S | G | A | P | P | P | S |   | NH2 | 396 |
| V | N | W | Iva | L | A | Q | R | P | S | S | G | A | P | P | P | S |   | NH2 | 397 |
| V | N | W | Iva | L | A | Q | R | P | S | S | G | A | P | P | P | S |   | NH2 | 398 |
| V | N | W | Iva | L | A | Q | R | P | S | S | G | A | P | P | P | S |   | NH2 | 399 |
| V | N | W | Iva | L | A | Q | R |   |   |   |   |   |   |   |   |   |   | NH2 | 400 |
| V | N | W | Iva | L | A | Q | R |   |   |   |   |   |   |   |   |   |   | NH2 | 401 |
| V | N | W | Iva | L | A | Q | R |   |   |   |   |   |   |   |   |   |   | NH2 | 402 |
| V | N | W | Iva | L | A | Q | R |   |   |   |   |   |   |   |   |   |   | NH2 | 403 |
| V | N | W | Iva | L | A | Q | R |   |   |   |   |   |   |   |   |   |   | NH2 | 404 |
| V | N | W | Iva | L | A | Q | R |   |   |   |   |   |   |   |   |   |   | NH2 | 405 |
| V | N | W | Iva | L | A | Q | R | P | S | S | G | A | P | P | P | S |   | OH | 406 |
| V | N | W | Iva | L | A | Q | R | P | S | S | G | A | P | P | P | S |   | OH | 407 |
| V | N | W | Iva | L | A | Q | R | P | S | S | G | A | P | P | P | S |   | OH | 408 |
| V | N | W | Iva | L | A | Q | R | P | S | S | G | A | P | P | P | S |   | OH | 409 |
| V | N | W | Iva | L | A | Q | R | P | S | S | G | A | P | P | P | S |   | OH | 410 |
| V | N | W | Iva | L | A | Q | R | P | S | S | G | A | P | P | P | S |   | OH | 411 |
| V | N | W | Iva | L | A | Q | R | P | S | S | G | A | P | P | P | S |   | OH | 412 |
| V | N | W | Iva | L | A | Q | R | P | S | S | G | A | P | P | P | S |   | OH | 413 |
| V | N | W | Iva | L | A | Q | R | P | S | S | G | A | P | P | P | S |   | OH | 414 |
| V | N | W | Iva | L | A | Q | R | P | S | S | G | A | P | P | P | S |   | OH | 415 |
| V | N | W | Iva | L | A | Q | R | P | S | S | G | A | P | P | P | S |   | OH | 416 |
| V | N | W | Iva | L | A | Q | R | P | S | S | G | A | P | P | P | S |   | OH | 417 |
| V | N | W | Iva | L | A | Q | R | P | S | S | G | A | P | P | P | S |   | OH | 418 |
| V | N | W | Iva | L | A | Q | R | P | S | S | G | A | P | P | P | S |   | OH | 419 |
| V | N | W | Iva | L | A | Q | R | P | S | S | G | A | P | P | P | S |   | OH | 420 |
| V | N | W | Iva | L | A | Q | R | P | S | S | G | A | P | P | P | S |   | OH | 421 |
| V | N | W | Iva | L | A | Q | R | P | S | S | G | A | P | P | P | S |   | NH2 | 422 |
| V | N | W | Iva | L | A | Q | R | P | S | S | G | A | P | P | P | S |   | NH2 | 423 |
| V | N | W | Iva | L | A | Q | R |   |   |   |   |   |   |   |   |   |   | NH2 | 424 |
| V | N | W | Iva | L | A | Q | R |   |   |   |   |   |   |   |   |   |   | NH2 | 425 |
| V | N | W | Iva | L | A | Q | R |   |   |   |   |   |   |   |   |   |   | NH2 | 426 |
| V | N | W | Iva | L | A | Q | R |   |   |   |   |   |   |   |   |   |   | NH2 | 427 |
| V | N | W | Iva | L | A | Q | R |   |   |   |   |   |   |   |   |   |   | NH2 | 428 |
| V | N | W | Iva | L | A | Q |   |   |   |   |   |   |   |   |   |   |   | OH | 429 |
| V | N | W | Iva | L | A | Q |   |   |   |   |   |   |   |   |   |   |   | OH | 430 |
| V | N | W | Iva | L | A | Q |   |   |   |   |   |   |   |   |   |   |   | OH | 431 |
| V | N | W | Iva | L | A | Q |   |   |   |   |   |   |   |   |   |   |   | OH | 432 |
| V | N | W | Iva | L | A | Q | R | P | S | S | G | A | P | P | P | S |   | NH2 | 433 |
| V | N | W | Iva | L | A | Q | R | P | S | S | G | A | P | P | P | S |   | NH2 | 434 |
| V | N | W | Iva | L | A | Q | R |   |   |   |   |   |   |   |   |   |   | OH | 435 |
| V | N | W | Iva | L | A | Q | R |   |   |   |   |   |   |   |   |   |   | OH | 436 |
| V | N | W | Iva | L | A | Q | R |   |   |   |   |   |   |   |   |   |   | OH | 437 |
| V | N | W | Iva | L | A | Q | R |   |   |   |   |   |   |   |   |   |   | OH | 438 |
| V | N | W | Iva | L | A | Q | R |   |   |   |   |   |   |   |   |   |   | OH | 439 |
| V | N | W | Iva | L | A | Q | R |   |   |   |   |   |   |   |   |   |   | OH | 440 |
| V | N | W | Iva | L | A | Q | K(Eda-GGGGG-) |   |   |   |   |   |   |   |   |   |   | NH2 | 441 |
| V | N | W | Iva | L | A | Q | K(Eda-PEG(2)-) |   |   |   |   |   |   |   |   |   |   | NH2 | 442 |
| V | N | W | Iva | L | A | Q | K(Eda-GGGGG-) |   |   |   |   |   |   |   |   |   |   | OH | 443 |
| V | N | W | Iva | L | A | Q | K(Eda-PEG(2)-) |   |   |   |   |   |   |   |   |   |   | OH | 444 |
| V | N | W | Iva | L | A | Q | R | P | S | S | G | A | P | P | P | S |   | OH | 445 |
| V | N | W | Iva | L | A | Q | R | P | S | S | G | A | P | P | P | S |   | OH | 446 |
| V | N | W | Iva | L | A | Q | R | P | S | S | G | A | P | P | P | S |   | OH | 447 |
| V | N | W | Iva | L | A | Q | R | P | S | S | G | A | P | P | P | S |   | NH2 | 448 |
| V | N | W | Iva | L | A | Q | R | P | S | S | G | A | P | P | P | S |   | NH2 | 449 |
| V | N | W | Iva | L | A | Q | R | P | S | S | G | A | P | P | P | S |   | OH | 450 |
| V | N | W | Iva | L | A | Q | R | P | S | S | G | A | P | P | P | S |   | OH | 451 |
| V | N | W | Iva | L | A | Q | R | P | S | S | G | A | P | P | P | S |   | NH2 | 452 |
| V | N | W | Iva | L | A | Q | R | P | S | S | G | A | P | P | P | S |   | NH2 | 453 |
| V | N | W | Iva | L | A | Q | R | P | S | S | G | A | P | P | P | S |   | OH | 454 |
| V | N | W | Iva | L | A | Q | R | P | S | S | G | A | P | P | P | S |   | OH | 455 |
| V | N | W | Iva | L | A | Q | R | P | S | S | G | A | P | P | P | S |   | OH | 456 |
| V | N | W | Iva | L | A | Q | R | P | S | S | G | A | P | P | P | S |   | OH | 457 |
| V | N | W | Iva | L | A | Q | R | P | S | S | G | A | P | P | P | S |   | NH2 | 458 |
| V | N | W | Iva | L | A | Q | R | P | S | S | G | A | P | P | P | S |   | NH2 | 459 |
| V | N | W | Iva | L | A | Q | R | P | S | S | G | A | P | P | P | S |   | NH2 | 460 |
| V | N | W | Iva | L | A | Q | R | P | S | S | G | A | P | P | P | S |   | NH2 | 461 |
| V | N | W | Iva | L | A | Q | R | P | S | S | G | A | P | P | P | S |   | NH2 | 462 |

FIG. 9M

| compond # | N | 1 | 2 | 3 | 4 | 5 | 6 | 7 | 8 | 9 | 10 | 11 | 12 | 13 |
|---|---|---|---|---|---|---|---|---|---|---|---|---|---|---|
| 450 | Me | Y | Aib | E | G | T | Iva | I | S | D | Y | S | I | Aib |
| 451 | Me | Y | Aib | E | G | T | Iva | I | S | D | Y | S | I | Aib |
| 452 | Me | Y | Aib | E | G | T | Iva | I | S | D | Y | S | I | Aib |
| 453 | Me | Y | Aib | E | G | T | Iva | I | S | D | Y | S | I | Aib |
| 454 | Me | Y | Aib | E | G | T | Iva | I | S | D | Y | S | I | Aib |
| 455 | Me | Y | Aib | E | G | T | Iva | I | S | D | Y | S | I | Aib |
| 456 | Me | Y | Aib | E | G | T | Iva | I | S | D | Y | S | I | Aib |
| 457 | Me | Y | Aib | E | G | T | Iva | I | S | D | Y | S | I | Aib |
| 458 | Me | Y | Aib | E | G | T | Iva | I | S | D | Y | S | I | Aib |
| 459 | Me | Y | Aib | E | G | T | Iva | I | S | D | Y | S | I | Aib |
| 460 | Me | Y | Aib | E | G | T | Iva | I | S | D | Y | S | I | Aib |
| 461 | Me | Y | Aib | E | G | T | Iva | I | S | D | Y | S | I | Aib |
| 462 | Me | Y | Aib | E | G | T | Iva | I | S | D | Y | S | I | Aib |
| 463 | Me | Y | Aib | E | G | T | Iva | I | S | D | Y | S | I | Aib |
| 464 | Me | Y | Aib | E | G | T | Iva | I | S | D | Y | S | I | Aib |
| 465 | Me | Y | Aib | E | G | T | Iva | I | S | D | Y | S | I | Aib |
| 466 | Me | Y | Aib | E | G | T | Iva | I | S | D | Y | S | I | Aib |
| 467 | Me | Y | Aib | E | G | T | Iva | I | S | D | Y | S | I | Aib |
| 471 | Me | Y | Aib | E | G | T | F | I | S | D | Y | S | I | A |
| 472 | Me | Y | Aib | E | G | T | F | I | S | D | Y | S | I | A |
| 473 | Me | Y | Aib | E | G | T | Iva | I | S | D | Y | S | I | Aib |
| 474 | Me | Y | Aib | E | G | T | Iva | I | S | D | Y | S | I | Aib |
| 475 | Me | Y | Aib | E | G | T | Iva | I | S | D | Y | S | I | Aib |
| 476 | Me | Y | Aib | E | G | T | Iva | I | S | D | Y | S | I | Aib |
| 477 | Me | Y | Aib | E | G | T | Iva | I | S | D | Y | S | I | Aib |
| 478 | Me | Y | Aib | E | G | T | Iva | I | S | D | Y | S | I | Aib |
| 479 | Me | Y | Aib | E | G | T | Iva | I | S | D | Y | S | I | Aib |
| 480 | Me | Y | Aib | E | G | T | Iva | I | S | D | Y | S | I | Aib |
| 481 | Me | Y | Aib | E | G | T | F | I | S | D | Y | S | I | A |
| 482 | Me | Y | Aib | E | G | T | F | I | S | D | Y | S | I | A |
| 483 | Me | Y | Aib | E | G | T | Iva | I | S | D | Y | S | I | Aib |
| 484 | Me | Y | Aib | E | G | T | Iva | I | S | D | Y | S | I | Aib |
| 485 | Me | Y | Aib | E | G | T | F | I | S | D | Y | S | I | A |
| 486 | Me | Y | Aib | E | G | T | F | I | S | D | Y | S | I | A |
| 487 | Me | Y | Aib | E | G | T | F | I | S | D | Y | S | I | A |
| 488 | Me | Y | Aib | E | G | T | Iva | I | S | D | Y | S | I | Aib |
| 489 | Me | Y | Aib | E | G | T | Iva | I | S | D | Y | S | I | Aib |
| 490 | Me | Y | Aib | E | G | T | Iva | I | S | D | Y | S | I | Aib |
| 491 | Me | Y | Aib | E | G | T | Iva | I | S | D | Y | S | I | Aib |
| 492 | Me | Y | Aib | E | G | T | Iva | I | S | D | Y | S | I | Aib |
| 493 | Me | Y | Aib | E | G | T | Iva | I | S | D | Y | S | I | Aib |
| 494 | Me | Y | Aib | E | G | T | Iva | I | S | D | Y | S | I | Aib |
| 495 | Me | Y | Aib | E | G | T | Iva | I | S | D | Y | S | I | Aib |
| 496 | Me | Y | Aib | E | G | T | Iva | I | S | D | Y | S | I | Aib |
| 497 | Me | Y | Aib | E | G | T | F | I | S | D | Y | S | I | A |
| 498 | Me | Y | Aib | E | G | T | F | I | S | D | Y | S | I | A |
| 499 | Me | Y | Aib | E | G | T | F | I | S | D | Y | S | I | A |
| 500 | Me | Y | Aib | E | G | T | Iva | I | S | D | Y | S | I | Aib |
| 501 | Me | Y | Aib | E | G | T | Iva | I | S | D | Y | S | I | Aib |
| 502 | Me | Y | Aib | E | G | T | Iva | I | S | D | Y | S | I | Aib |
| 503 | Me | Y | Aib | E | G | T | Iva | I | S | D | Y | S | I | Aib |
| 504 | Me | Y | Aib | E | G | T | Iva | I | S | D | Y | S | I | Aib |
| 505 | Me | Y | Aib | E | G | T | Iva | I | S | D | Y | S | I | Aib |
| 506 | Me | Y | Aib | E | G | T | Iva | I | S | D | Y | S | I | Aib |
| 507 | Me | Y | Aib | E | G | T | Iva | I | S | D | Y | S | I | Aib |
| 508 | Me | Y | Aib | E | G | T | Iva | I | S | D | Y | S | I | Aib |
| 509 | Me | Y | Aib | E | G | T | Iva | I | S | D | Y | S | I | Aib |
| 510 | Me | Y | Aib | E | G | T | Iva | I | S | D | Y | S | I | Aib |
| 511 | Me | Y | Aib | E | G | T | F | I | S | D | Y | S | I | A |
| 512 | Me | Y | Aib | E | G | T | F | I | S | D | Y | S | I | A |
| 513 | Me | Y | Aib | E | G | T | F | I | S | D | Y | S | I | A |
| 514 | Me | Y | Aib | E | G | T | F | I | S | D | Y | S | I | A |
| 515 | Me | Y | Aib | E | G | T | Iva | I | S | D | Y | S | I | Aib |
| 516 | Me | Y | Aib | E | G | T | Iva | I | S | D | Y | S | I | Aib |
| 517 | Me | Y | Aib | E | G | T | Iva | I | S | D | Y | S | I | Aib |
| 518 | Me | Y | Aib | E | G | T | F | I | S | D | Y | S | I | A |
| 519 | Me | Y | Aib | E | G | T | Iva | I | S | D | Y | S | I | Aib |
| 520 | Me | Y | Aib | E | G | T | Iva | I | S | D | Y | S | I | Aib |
| 521 | Me | Y | Aib | E | G | T | Iva | I | S | D | Y | S | I | Aib |
| 522 | Me | Y | Aib | E | G | T | F | I | S | D | Y | S | I | A |

FIG. 9N

| | | | Amino acid | | | | | |
|---|---|---|---|---|---|---|---|---|
| 14 | 15 | 16 | 17 | 18 | 19 | 20 | 21 | 22 |
| K(Trda-GGGGGG-) | D | R | Aib | A | Q | Aib | N | F |
| K(Teda-GGGG-) | D | R | Aib | A | Q | Aib | N | F |
| K(Teda-GGGGGG-) | D | R | Aib | A | Q | Aib | N | F |
| K(Peda-GGGGG-) | D | R | Aib | A | Q | Aib | N | F |
| K(Peda-GGGGG-) | D | R | Aib | A | Q | Aib | N | F |
| K(Peda-GGGGGG-) | D | R | Aib | A | Q | Aib | N | F |
| K(Heda-GGGGG-) | D | R | Aib | A | Q | Aib | N | F |
| K(Heda-GGGGGG-) | D | R | Aib | A | Q | Aib | N | F |
| K(Oda-GGGGG-) | D | R | Aib | A | Q | Aib | N | F |
| K(Hda-GGGGG-) | D | R | Aib | A | Q | Aib | N | F |
| L | D | R | K(Doda-GGGGG-) | A | Q | Aib | N | F |
| L | D | R | K(Teda-GGGGG-) | A | Q | Aib | N | F |
| L | D | R | K(Heda-GGGGG-) | A | Q | Aib | N | F |
| L | D | R | Lys(Hepda-GGGGG-) | A | Q | Aib | N | F |
| K(Hepda-GGGG-) | D | R | Aib | A | Q | Aib | N | F |
| K(Hepda-GGGGG-) | D | R | Aib | A | Q | Aib | N | F |
| K(Hepda-GGGGGG-) | D | R | Aib | A | Q | Aib | N | F |
| K(Hda-G9-) | D | R | Aib | A | Q | Aib | N | F |
| K(Eda-GGGGG-) | D | R | Aib | H | Q | Aib | N | F |
| K(Teda-GGGGG-) | D | R | Aib | H | Q | Aib | N | F |
| K(Eda-GGGGG-) | D | R | Aib | A | Q | Aib | N | F |
| K(Teda-GGGGG-) | D | R | Aib | A | Q | Aib | N | F |
| K(Eda-GGGGG-) | D | R | Aib | H | Q | Aib | N | F |
| K(Teda-GGGGG-) | D | R | Aib | H | Q | Aib | N | F |
| K(Heda-GGGGGG-) | D | R | Aib | A | Q | Aib | N | F |
| K(Heda-GGGGG-) | D | R | Aib | A | Q | Aib | N | F |
| K(Oda-GGGGGG-) | D | R | Aib | A | Q | Aib | N | F |
| K(Oda-GGGGG-) | D | R | Aib | A | Q | Aib | N | F |
| K(Oda-GGGGG-) | D | R | Aib | H | Q | Aib | N | F |
| K(Oda-GGGGGG-) | D | R | Aib | H | Q | Aib | N | F |
| K(Oda-GGGGG-) | D | R | Aib | H | Q | Aib | N | F |
| K(Oda-GGGGGG-) | D | R | Aib | H | Q | Aib | N | F |
| L | D | R | K(Oda-GGGGG-) | H | Q | Aib | N | F |
| L | D | R | K(Oda-GGGGGG-) | H | Q | Aib | N | F |
| L | D | R | K(Eda-GGGGG-) | H | Q | Aib | N | F |
| L | D | R | K(Oda-GGGGG-) | A | Q | Aib | N | F |
| L | D | R | K(Oda-GGGGGG-) | A | Q | Aib | N | F |
| L | D | R | K(Eda-GGGGG-) | A | Q | Aib | N | F |
| L | D | R | K(Oda-GGGGG-) | H | Q | Aib | N | F |
| L | D | R | K(Oda-GGGGGG-) | H | Q | Aib | N | F |
| L | D | R | K(Eda-GGGGG-) | H | Q | Aib | N | F |
| L | D | R | K(Heda-GGGGGG-) | A | Q | Aib | N | F |
| L | D | R | K(Hepda-GGGGGG-) | A | Q | Aib | N | F |
| L | D | R | K(Oda-GGGGGG-) | A | Q | Aib | N | F |
| L | D | R | K(Hepda-GGGGG-) | H | Q | Aib | N | F |
| L | D | R | K(Heda-GGGGGG-) | H | Q | Aib | N | F |
| L | D | R | K(Hepda-GGGGGG-) | H | Q | Aib | N | F |
| L | D | R | K(Hepda-GGGGG-) | A | Q | Aib | N | F |
| L | D | R | K(Hepda-GGGGGG-) | A | Q | Aib | N | F |
| L | D | R | K(Hepda-GGGGG-) | H | Q | Aib | N | F |
| L | D | R | K(Heda-GGGGGG-) | H | Q | Aib | N | F |
| L | D | R | K(Hepda-GGGGGG-) | H | Q | Aib | N | F |
| K(Hepda-GGGGG-) | D | R | Aib | A | Q | Aib | N | F |
| K(Hepda-GGGGGG-) | D | R | Aib | A | Q | Aib | N | F |
| K(Heda-GGGGG-) | D | R | Aib | H | Q | Aib | N | F |
| K(Hepda-GGGGG-) | D | R | Aib | H | Q | Aib | N | F |
| K(Heda-GGGGGG-) | D | R | Aib | H | Q | Aib | N | F |
| K(Hepda-GGGGGG-) | D | R | Aib | H | Q | Aib | N | F |
| K(Heda-GGGGG-) | D | R | Aib | H | Q | Aib | N | F |
| K(Hepda-GGGGG-) | D | R | Aib | H | Q | Aib | N | F |
| K(Heda-GGGGGG-) | D | R | Aib | H | Q | Aib | N | F |
| K(Hepda-GGGGGG-) | D | R | Aib | H | Q | Aib | N | F |
| L | D | R | K(Heda-GGGGG-) | A | Q | Aib | N | F |
| L | D | R | K(Heda-GGGGGG-) | A | Q | Aib | N | F |
| L | D | R | K(Heda-GGGGG-) | H | Q | Aib | N | F |
| L | D | R | K(Heda-GGGGG-) | H | Q | Aib | N | F |
| K(Oda-PEG(2)-) | D | R | Aib | A | Q | Aib | N | F |
| K(Eda-GGGGGG-) | D | R | Aib | A | Q | Aib | N | F |
| K(Eda-GGGGGG-) | D | R | Aib | H | Q | Aib | N | F |
| K(Eda-GGGGGG-) | D | R | Aib | H | Q | Aib | N | F |

FIG. 90

| 23 | 24 | 25 | 26 | 27 | 28 | 29 | 30 | 31 | 32 | 33 | 34 | 35 | 36 | 37 | 38 | 39 | 40 | C | SEQ ID # |
|---|---|---|---|---|---|---|---|---|---|---|---|---|---|---|---|---|---|---|---|
| V | N | W | Iva | L | A | Q | R | P | S | S | G | A | P | P | P | S |  | NH2 | 463 |
| V | N | W | Iva | L | A | Q | R | P | S | S | G | A | P | P | P | S |  | NH2 | 464 |
| V | N | W | Iva | L | A | Q | R | P | S | S | G | A | P | P | P | S |  | NH2 | 465 |
| V | N | W | Iva | L | A | Q | R | P | S | S | G | A | P | P | P | S |  | NH2 | 466 |
| V | N | W | Iva | L | A | Q | R | P | S | S | G | A | P | P | P | S |  | NH2 | 467 |
| V | N | W | Iva | L | A | Q | R | P | S | S | G | A | P | P | P | S |  | NH2 | 468 |
| V | N | W | Iva | L | A | Q | R | P | S | S | G | A | P | P | P | S |  | NH2 | 469 |
| V | N | W | Iva | L | A | Q | R | P | S | S | G | A | P | P | P | S |  | NH2 | 470 |
| V | N | W | Iva | L | A | Q | R | P | S | S | G | A | P | P | P | S |  | NH2 | 471 |
| V | N | W | Iva | L | A | Q | R | P | S | S | G | A | P | P | P | S |  | NH2 | 472 |
| V | N | W | Iva | L | A | Q | R | P | S | S | G | A | P | P | P | S |  | NH2 | 473 |
| V | N | W | Iva | L | A | Q | R | P | S | S | G | A | P | P | P | S |  | NH2 | 474 |
| V | N | W | Iva | L | A | Q | R | P | S | S | G | A | P | P | P | S |  | NH2 | 475 |
| V | N | W | Iva | L | A | Q | R | P | S | S | G | A | P | P | P | S |  | NH2 | 476 |
| V | N | W | Iva | L | A | Q | R | P | S | S | G | A | P | P | P | S |  | NH2 | 477 |
| V | N | W | Iva | L | A | Q | R | P | S | S | G | A | P | P | P | S |  | NH2 | 478 |
| V | N | W | Iva | L | A | Q | R | P | S | S | G | A | P | P | P | S |  | NH2 | 479 |
| V | N | W | Iva | L | A | Q | R | P | S | S | G | A | P | P | P | S |  | NH2 | 480 |
| V | N | W | Iva | L | A | Q | R | P | S | S | G | A | P | P | P | S | R | NH2 | 484 |
| V | N | W | Iva | L | A | Q | R | P | S | S | G | A | P | P | P | S | R | NH2 | 485 |
| V | N | W | Iva | L | A | Q | R | P | S | S | G | A | P | P | P | S | R | NH2 | 486 |
| V | N | W | Iva | L | A | Q | R | P | S | S | G | A | P | P | P | S | R | NH2 | 487 |
| V | N | W | Iva | L | A | Q | R | P | S | S | G | A | P | P | P | S |  | NH2 | 488 |
| V | N | W | Iva | L | A | Q | R | P | S | S | G | A | P | P | P | S |  | NH2 | 489 |
| V | N | W | Iva | L | A | Q | R | P | S | S | G | A | P | P | P | S | R | NH2 | 490 |
| V | N | W | Iva | L | A | Q | R | P | S | S | G | A | P | P | P | S | R | NH2 | 491 |
| V | N | W | Iva | L | A | Q | R | P | S | S | G | A | P | P | P | S | R | NH2 | 492 |
| V | N | W | Iva | L | A | Q | R | P | S | S | G | A | P | P | P | S | R | NH2 | 493 |
| V | N | W | Iva | L | A | Q | R | P | S | S | G | A | P | P | P | S | R | NH2 | 494 |
| V | N | W | Iva | L | A | Q | R | P | S | S | G | A | P | P | P | S | R | NH2 | 495 |
| V | N | W | Iva | L | A | Q | R | P | S | S | G | A | P | P | P | S |  | NH2 | 496 |
| V | N | W | Iva | L | A | Q | R | P | S | S | G | A | P | P | P | S |  | NH2 | 497 |
| V | N | W | Iva | L | A | Q | R | P | S | S | G | A | P | P | P | S | R | NH2 | 498 |
| V | N | W | Iva | L | A | Q | R | P | S | S | G | A | P | P | P | S | R | NH2 | 499 |
| V | N | W | Iva | L | A | Q | R | P | S | S | G | A | P | P | P | S | R | NH2 | 500 |
| V | N | W | Iva | L | A | Q | R | P | S | S | G | A | P | P | P | S | R | NH2 | 501 |
| V | N | W | Iva | L | A | Q | R | P | S | S | G | A | P | P | P | S | R | NH2 | 502 |
| V | N | W | Iva | L | A | Q | R | P | S | S | G | A | P | P | P | S | R | NH2 | 503 |
| V | N | W | Iva | L | A | Q | R | P | S | S | G | A | P | P | P | S |  | NH2 | 504 |
| V | N | W | Iva | L | A | Q | R | P | S | S | G | A | P | P | P | S |  | NH2 | 505 |
| V | N | W | Iva | L | A | Q | R | P | S | S | G | A | P | P | P | S |  | NH2 | 506 |
| V | N | W | Iva | L | A | Q | R | P | S | S | G | A | P | P | P | S |  | NH2 | 507 |
| V | N | W | Iva | L | A | Q | R | P | S | S | G | A | P | P | P | S |  | NH2 | 508 |
| V | N | W | Iva | L | A | Q | R | P | S | S | G | A | P | P | P | S |  | NH2 | 509 |
| V | N | W | Iva | L | A | Q | R | P | S | S | G | A | P | P | P | S | R | NH2 | 510 |
| V | N | W | Iva | L | A | Q | R | P | S | S | G | A | P | P | P | S | R | NH2 | 511 |
| V | N | W | Iva | L | A | Q | R | P | S | S | G | A | P | P | P | S | R | NH2 | 512 |
| V | N | W | Iva | L | A | Q | R | P | S | S | G | A | P | P | P | S | R | NH2 | 513 |
| V | N | W | Iva | L | A | Q | R | P | S | S | G | A | P | P | P | S | R | NH2 | 514 |
| V | N | W | Iva | L | A | Q | R | P | S | S | G | A | P | P | P | S |  | NH2 | 515 |
| V | N | W | Iva | L | A | Q | R | P | S | S | G | A | P | P | P | S |  | NH2 | 516 |
| V | N | W | Iva | L | A | Q | R | P | S | S | G | A | P | P | P | S |  | NH2 | 517 |
| V | N | W | Iva | L | A | Q | R | P | S | S | G | A | P | P | P | S | R | NH2 | 518 |
| V | N | W | Iva | L | A | Q | R | P | S | S | G | A | P | P | P | S | R | NH2 | 519 |
| V | N | W | Iva | L | A | Q | R | P | S | S | G | A | P | P | P | S |  | NH2 | 520 |
| V | N | W | Iva | L | A | Q | R | P | S | S | G | A | P | P | P | S |  | NH2 | 521 |
| V | N | W | Iva | L | A | Q | R | P | S | S | G | A | P | P | P | S |  | NH2 | 522 |
| V | N | W | Iva | L | A | Q | R | P | S | S | G | A | P | P | P | S |  | NH2 | 523 |
| V | N | W | Iva | L | A | Q | R | P | S | S | G | A | P | P | P | S | R | NH2 | 524 |
| V | N | W | Iva | L | A | Q | R | P | S | S | G | A | P | P | P | S | R | NH2 | 525 |
| V | N | W | Iva | L | A | Q | R | P | S | S | G | A | P | P | P | S | R | NH2 | 526 |
| V | N | W | Iva | L | A | Q | R | P | S | S | G | A | P | P | P | S | R | NH2 | 527 |
| V | N | W | Iva | L | A | Q | R | P | S | S | G | A | P | P | P | S | R | NH2 | 528 |
| V | N | W | Iva | L | A | Q | R | P | S | S | G | A | P | P | P | S | R | NH2 | 529 |
| V | N | W | Iva | L | A | Q | R | P | S | S | G | A | P | P | P | S |  | NH2 | 530 |
| V | N | W | Iva | L | A | Q | R | P | S | S | G | A | P | P | P | S | R | NH2 | 531 |
| V | N | W | Iva | L | A | Q | R | P | S | S | G | A | P | P | P | S |  | NH2 | 532 |
| V | N | W | Iva | L | A | Q | R | P | S | S | G | A | P | P | P | S | R | NH2 | 533 |
| V | N | W | Iva | L | A | Q | R | P | S | S | G | A | P | P | P | S |  | NH2 | 534 |
| V | N | W | Iva | L | A | Q | R | P | S | S | G | A | P | P | P | S | R | NH2 | 535 |

PEPTIDE COMPOUND

CROSS-REFERENCE TO RELATED APPLICATIONS

This application claims priority from Japanese application no. JP 2017-072556, filed Mar. 31, 2017.

SEQUENCE LISTING

The instant application contains a Sequence Listing which has been filed electronically in ASCII format and is hereby incorporated by reference in its entirety. Said ASCII copy, created on Mar. 29, 2018, is named 109100-0115_SL.txt and is 499,379 bytes in size.

TECHNICAL FIELD

Related Application

The present invention relates to a novel peptide compound having an activating action on GIP receptors and use of the peptide compound as a medicament.

BACKGROUND OF THE INVENTION

Both glucagon-like peptide-1 (GLP-1) and glucose-dependent insulinotropic polypeptide (GIP) are peptides called incretin. GLP-1 and GIP are secreted from small intestinal L cells and K cells, respectively.

GLP-1 acts via GLP-1 receptors and is known to have a glucose-dependent insulinotropic action and a feeding suppressive action. On the other hand, GIP is known to have a glucose-dependent insulinotropic action via GIP receptors, though an influence of GIP only on feeding is not clear.

Attempts have been made to search for peptides having GLP-1 receptor/GIP receptor coagonist or glucagon receptor/GLP-1 receptor/GIP receptor triagonist activity and modifications thereof and develop these peptides as anti-obesity drugs, therapeutic drugs for diabetes, or therapeutic drugs for neurodegenerative disorders on the basis of the structure of natural glucagon, GIP, or GLP-1 (Patent Literatures 1 to 50, Non-Patent Literatures 1 and 2). However, the peptide compound and the compound having a selective activating action on GIP receptors of the present invention are not disclosed.

CITATION LIST

Patent Literature

[Patent Literature 1] WO2010/011439
[Patent Literature 2] WO2010/148089
[Patent Literature 3] WO2011/119657
[Patent Literature 4] WO2012/088379
[Patent Literature 5] WO2012/167744
[Patent Literature 6] WO2013/164483
[Patent Literature 7] WO2013/192129
[Patent Literature 8] WO2013/192130
[Patent Literature 9] WO2016/084826
[Patent Literature 10] WO2014/192284
[Patent Literature 11] WO2017/204219
[Patent Literature 12] WO2016/066744
[Patent Literature 13] WO2006/086769
[Patent Literature 14] WO2007/109354
[Patent Literature 15] WO2008/021560
[Patent Literature 16] WO2009/042922
[Patent Literature 17] WO2010/071807
[Patent Literature 18] WO2011/094337
[Patent Literature 19] WO2012/088116
[Patent Literature 20] WO2013/003449
[Patent Literature 21] WO2006/121904
[Patent Literature 22] WO2007/028632
[Patent Literature 23] WO2005/082928
[Patent Literature 24] WO2000/069911
[Patent Literature 25] WO2016/034186
[Patent Literature 26] WO2017/075505
[Patent Literature 27] WO2017/116204
[Patent Literature 28] EP0479210
[Patent Literature 29] WO2003/082898
[Patent Literature 30] WO2007/028633
[Patent Literature 31] WO2010/016935
[Patent Literature 32] WO2010/016938
[Patent Literature 33] WO2010/016940
[Patent Literature 34] WO2010/016944
[Patent Literature 35] WO2011/014680
[Patent Literature 36] WO2012/055770
[Patent Literature 37] WO2014/096145
[Patent Literature 38] WO2014/096148
[Patent Literature 39] WO2014/096149
[Patent Literature 40] WO2014/096150
[Patent Literature 41] WO2015/022420
[Patent Literature 42] WO2015/067715
[Patent Literature 43] WO2015/067716
[Patent Literature 44] WO2015/086728
[Patent Literature 45] WO2015/086729
[Patent Literature 46] WO2015/086730
[Patent Literature 47] US2016/0015788
[Patent Literature 48] WO2016/077220
[Patent Literature 49] WO2016/111971
[Patent Literature 50] WO2016/198624

Non-Patent Literature

[Non-Patent Literature 1] Nat Med. 2013 December; 19(12): 1549. doi: 10.1038/nm1213-1549.
[Non-Patent Literature 2] Sci Transl Med. 2013 Oct. 30; 5(209):209ra151. doi: 10.1126/scitranslmed.3007218.

SUMMARY OF INVENTION

Technical Problem

It is an object of the present invention to provide a novel peptide compound which has a GIP receptor activation action and is useful as a preventive/therapeutic agent or an antiemetic agent for diabetes, obesity, and diseases accompanied by vomiting or nausea.

Solution to Problem

The present inventors have carried out extensive studies to solve the above problem and found peptide compounds comprising the sequence represented by formula (I) as novel compounds having an excellent GIP receptor activation action. Further, the inventors have found that these compounds selectively activate the GIP receptor and have an antiemetic action, leading to the completion of the present invention.

More specifically, the present invention relates to the following [1] to [26].

[1] A peptide represented by formula (I):

P¹-Tyr-A2-Glu-Gly-Thr-A6-A7-A8-A9-A10-A11-
A12-A13-A14-A15-A16-A17-A18-A19-A20-
A21-A22-A23-A24-A25-A26-A27-A28-A29-
A30-A31-A32-A33-A34-A35-A36-A37-A38-
A39-A40-P² (SEQ ID NO: 165)

wherein
P¹ represents a group represented by formula

—CO—R$^{41}$,

—CO—OR$^{41}$,

—CO—COR$^{41}$,

—SO—R$^{41}$,

—SO$_2$—R$^{41}$,

—SO$_2$—OR$^{41}$,

—CO—NR$^{42}$R$^{43}$,

—SO$_2$—NR$^{42}$R$^{43}$, or

—C(=NR$^{41}$)—NR$^{42}$R$^{43}$ wherein R$^{41}$, R$^{42}$, and R$^{43}$ each independently represent a hydrogen atom, an optionally substituted hydrocarbon group, or an optionally substituted heterocyclic group;
P² represents —NH$_2$ or —OH;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A17 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, Gly, or a deletion;
A31 represents Pro or a deletion;
A32 represents Ser or a deletion;
A33 represents Ser or a deletion;
A34 represents Gly or a deletion;
A35 represents Ala or a deletion;
A36 represents Pro or a deletion;
A37 represents Pro or a deletion;
A38 represents Pro or a deletion;
A39 represents Lys, Ser, or a deletion;
A40 represents Arg, Lys, or a deletion; and
any one or two amino acids selected from A8 to A30 optionally represent Lys(R), and R represents a substituent group,
provided that where all A31 to A40 represent deletions, then A2 represents Aib,
or a salt thereof.

[2] The peptide according to [1] represented by formula (II):

P¹-Tyr-A2-Glu-Gly-Thr-A6-A7-A8-A9-A10-A11-
A12-A13-A14-A15-A16-A17-A18-A19-A20-
A21-A22-A23-A24-A25-A26-A27-A28-A29-
A30-Pro-Ser-Ser-Gly-Ala-Pro-Pro-Pro-A39-
A40-P² (SEQ ID NO: 166)

wherein
P¹ represents a group represented by formula

—R$^{41}$,

—CO—R$^{41}$,

—CO—OR$^{41}$,

—CO—COR$^{41}$,

—SO—R$^{41}$,

—SO$_2$—R$^{41}$,

—SO$_2$—OR$^{41}$,

—CO—NR$^{42}$R$^{43}$,

—SO$_2$—NR$^{42}$R$^{43}$, or

—C(=NR$^{41}$)—NR$^{42}$R$^{43}$ wherein R$^{41}$, R$^{42}$, and R$^{43}$ each independently represent a hydrogen atom, an optionally substituted hydrocarbon group, or an optionally substituted heterocyclic group;
P² represents —NH$_2$ or —OH;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A17 represents Aib, Gln, or Ile;
A18 represents Ala or His;
A19 represents Gln or Ser;
A20 represents Aib, Ala, or Gln;
A21 represents Asn, Asp, Glu, Leu or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg or Gly;
A39 represents Lys or Ser;
A40 represents Arg, Lys, or a deletion; and
any one or two amino acids selected from A8 to A30 optionally represent Lys(R), and R represents a substituent group,
or a salt thereof.

[3] The peptide according to [1] represented by formula (III):

$P^1$-Tyr-A2-Glu-Gly-Thr-Val-A7-A8-A9-A10-A11-A12-A13-A14-A15-A16-A17-A18-A19-A20-A21-A22-A23-A24-A25-A26-A27-A28-A29-A30-Pro-Ser-Ser-Gly-Ala-Pro-Pro-Pro-A39-A40-$P^2$ (SEQ ID NO: 167)

wherein
$P^1$ represents a group represented by formula

—$R^{41}$,

—CO—$R^{41}$,

—CO—O$R^{41}$,

—CO—CO$R^{41}$,

—SO—$R^{41}$,

—SO$_2$—O$R^{41}$,

—SO$_2$—O$R^{41}$,

—CO—N$R^{42}R^{43}$,

—SO$_2$—N$R^{42}R^{43}$, or

—C(=N$R^{41}$)—N$R^{42}R^{43}$ wherein $R^{41}$, $R^{42}$, and $R^{43}$ each independently represent a hydrogen atom, an optionally substituted hydrocarbon group, or an optionally substituted heterocyclic group;
$P^2$ represents —NH$_2$ or —OH;
A2 represents Aib or D-Ala;
A7 represents Ile, Lys, or Val;
A8 represents Ser;
A9 represents Asp, Leu, or Phe;
A10 represents Tyr;
A11 represents Ser;
A12 represents Ile;
A13 represents Aib, Ala, Gln, Leu, or Tyr;
A14 represents Leu;
A15 represents Asp, Glu, Lys, Ser, or Tyr;
A16 represents Lys;
A17 represents Gln, or Ile;
A18 represents Ala or His;
A19 represents Gln or Ser;
A20 represents Aib, or Gln;
A21 represents Glu, or Leu;
A22 represents Phe;
A23 represents Ile or Val;
A24 represents Lys, or Lys(Ac);
A25 represents Trp;
A26 represents Aib, or Leu;
A27 represents Leu;
A28 represents Lys, or Lys(Ac);
A29 represents Gly;
A30 represents Gly;
A39 represents Lys, or Ser;
A40 represents Lys, or a deletion; and
any one or two amino acids selected from A8 to A30 optionally represent Lys(R), and R represents a substituent group,
or a salt thereof.

[4] The peptide according to [1] represented by formula (IV):

$P^1$-Tyr-Aib-Glu-Gly-Thr-A6-A7-A8-A9-A10-A11-A12-A13-A14-A15-A16-A17-A18-A19-A20-A21-A22-A23-A24-A25-A26-A27-A28-A29-A30-Pro-Ser-Ser-Gly-Ala-Pro-Pro-Pro-Ser-A40-$P^2$ (SEQ ID NO: 168)

wherein
$P^1$ represents a group represented by formula

—$R^{41}$,

—CO—$R^{41}$,

—CO—O$R^{41}$,

—CO—CO$R^{41}$,

—SO—$R^{41}$,

—SO$_2$—$R^{41}$,

—SO$_2$—O$R^{41}$,

—CO—N$R^{42}R^{43}$,

—SO$_2$—N$R^{42}R^{43}$, or

—C(=N$R^{41}$)—N$R^{42}R^{43}$ wherein $R^{41}$, $R^{42}$, and $R^{43}$ each independently represent a hydrogen atom, an optionally substituted hydrocarbon group, or an optionally substituted heterocyclic group;
$P^2$ represents —NH$_2$ or —OH;
A6 represents Iva, Phe, or Val;
A7 represents Ile or Val;
A8 represents Ser;
A9 represents Asp or Leu;
A10 represents Tyr;
A11 represents Aib or Ser;
A12 represents Ile;
A13 represents Aib, Ala, or D-Iva;
A14 represents Leu;
A15 represents Asp;
A16 represents Arg;
A17 represents Aib, Gln, or Ile;
A18 represents Ala or His;
A19 represents Gln;
A20 represents Aib, Ala, or Gln;
A21 represents Glu, Asn, Asp, or Ser;
A22 represents Phe or αMePhe;
A23 represents Val;
A24 represents Arg, Asp, or Asn;
A25 represents Trp;
A26 represents Leu or Iva;
A27 represents Leu;
A28 represents Ala or Arg;
A29 represents Gln or Gly;
A30 represents Arg or Gly;
A40 represents Arg or a deletion; and
any one or two amino acids selected from A8 to A30 optionally represent Lys(R), and R represents a substituent group,
or a salt thereof.

[5] The peptide according to [1] represented by formula (V):

P¹-Tyr-Aib-Glu-Gly-Thr-A6-A7-A8-A9-A10-A11-
A12-A13-A14-A15-A16-A17-A18-A19-A20-
A21-A22-A23-A24-A25-A26-A27-A28-A29-
A30-A31-A32-A33-A34-A35-A36-A37-A38-
A39-A40-P² (SEQ ID NO: 169)

wherein
P¹ represents a group represented by formula

—$R^{41}$,

—CO—$R^{41}$,

—CO—$OR^{41}$,

—CO—$COR^{41}$,

—SO—$R^{41}$,

—$SO_2$—$R^{41}$,

—$SO_2$—$OR^{41}$,

—CO—$NR^{42}R^{43}$,

—$SO_2$—$NR^{42}R^{43}$, or

—C(=$NR^{41}$)—$NR^{42}R^{43}$ wherein $R^{41}$, $R^{42}$, and $R^{43}$ each independently represent a hydrogen atom, an optionally substituted hydrocarbon group, or an optionally substituted heterocyclic group;
P² represents —$NH_2$ or —OH;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A11 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, Gly or a deletion;
A31 to A40 represent a deletion; and
any one or two amino acids selected from A8 to A30 optionally represent Lys(R), and R represents a substituent group,
or a salt thereof.

[6] The peptide according to [1] represented by formula (VI):

P¹-Tyr-Aib-Glu-Gly-Thr-A6-A7-A8-A9-A10-A11-
A12-A13-A14-A15-A16-A17-A18-A19-A20-
A21-A22-A23-A24-A25-A26-A27-A28-A29-
A30-Pro-Ser-Ser-Gly-Ala-Pro-Pro-Pro-Ser-A40-
P² (SEQ ID NO: 170)

wherein
P¹ represents a group represented by formula

—$R^{41}$,

—CO—$R^{41}$,

—CO—$OR^{41}$,

—CO—$COR^{41}$,

—SO—$R^{41}$,

—$SO_2$—$R^{41}$,

—$SO_2$—$OR^{41}$,

—CO—$NR^{42}R^{43}$,

—$SO_2$—$NR^{42}R^{43}$, or

—C(=$NR^{41}$)—$NR^{42}R^{43}$ wherein $R^{41}$, $R^{42}$, and $R^{43}$ each independently represent a hydrogen atom, an optionally substituted hydrocarbon group, or an optionally substituted heterocyclic group;
P² represents —$NH_2$ or —OH;
A6 represents Iva, Phe, or Val;
A7 represents Ile or Val;
A8 represents Ser;
A9 represents Asp or Leu;
A10 represents Tyr;
A11 represents Ser;
A12 represents Ile;
A13 represents Aib or Ala;
A14 represents Leu;
A15 represents Asp;
A16 represents Arg or Lys;
A11 represents Aib, Gln, or Ile;
A18 represents Ala or His;
A19 represents Gln;
A20 represents Aib, or Gln;
A21 represents Asn, Glu, or Asp;
A22 represents Phe;
A23 represents Val;
A24 represents Arg, Asn, or Lys;
A25 represents Trp;
A26 represents Iva or Leu;
A27 represents Leu;
A28 represents Ala, Arg, or Lys;
A29 represents Gln or Gly;
A30 represents Arg, or Gly;
A40 represents Arg, Lys, or a deletion; and
any one or two amino acids selected from A8 to A30 optionally represent Lys(R), and R represents a substituent group,
or a salt thereof.

[7] The peptide according to [1] represented by formula (I):

P¹-Tyr-A2-Glu-Gly-Thr-A6-A7-A8-A9-A10-A11-
A12-A13-A14-A15-A16-A17-A18-A19-A20-
A21-A22-A23-A24-A25-A26-A27-A28-A29-
A30-A31-A32-A33-A34-A35-A36-A37-A38-
A39-A40-P² wherein
P¹ represents a group represented by formula

—$R^{41}$,

—CO—$R^{41}$,

—CO—$OR^{41}$,

—CO—COR$^{41}$,

—SO—R$^{41}$,

—SO$_2$—R$^{41}$,

—SO$_2$—OR$^{41}$,

—CO—NR$^{42}$R$^{43}$,

—SO$_2$—NR$^{42}$R$^{43}$, or

—C(=NR$^{41}$)—NR$^{42}$R$^{43}$ wherein R$^{41}$, R$^{42}$, and R$^{43}$ each independently represent a hydrogen atom, an optionally substituted hydrocarbon group, or an optionally substituted heterocyclic group;
P$^2$ represents —NH$_2$ or —OH;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A11 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Asp, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, Gly or a deletion;
A31 represents Pro or a deletion;
A32 represents Ser or a deletion;
A33 represents Ser or a deletion;
A34 represents Gly or a deletion;
A35 represents Ala or a deletion;
A36 represents Pro or a deletion;
A37 represents Pro or a deletion;
A38 represents Pro or a deletion;
A39 represents Lys, Ser or a deletion; and
A40 represents Arg, Lys, or a deletion,
or a salt thereof.

[8] The peptide according to [1] represented by formula (I):

P$^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-P$^2$ wherein
P$^1$ represents a group represented by formula

—R$^{41}$,

—CO—R$^{41}$,

—CO—OR$^{41}$,

—CO—COR$^{41}$,

—SO—R$^{41}$,

—SO$_2$—R$^{41}$,

—SO$_2$—OR$^{41}$,

—CO—NR$^{42}$R$^{43}$,

—SO$_2$—NR$^{42}$R$^{43}$, or

—C(=NR$^{41}$)—NR$^{42}$R$^{43}$ wherein R$^{41}$, R$^{42}$, and R$^{43}$ each independently represent a hydrogen atom, an optionally substituted hydrocarbon group, or an optionally substituted heterocyclic group;
P$^2$ represents —NH$_2$ or —OH;
A2 represents Aib or D-Ala;
A6 represents Iva, Phe, or Val;
A7 represents Ile, Lys, or Val;
A8 represents Ser;
A9 represents Asp, Leu, or Phe;
A10 represents Tyr;
A11 represents Aib or Ser;
A12 represents Ile;
A13 represents Aib, Ala, Gln, Leu, Tyr, or D-Iva;
A14 represents Leu;
A15 represents Asp, Glu, Lys, Ser, or Tyr;
A16 represents Arg or Lys;
A11 represents Aib, Gln, or Ile;
A18 represents Ala or His;
A19 represents Gln or Ser;
A20 represents Aib, Ala, or Gln;
A21 represents Asn, Asp, Glu, Leu, or Ser;
A22 represents Phe or αMePhe;
A23 represents Ile or Val;
A24 represents Arg, Asn, Lys, or Lys(Ac);
A25 represents Trp;
A26 represents Aib, Iva, or Leu;
A27 represents Leu;
A28 represents Ala, Arg, Lys, or Lys(Ac);
A29 represents Gln or Gly;
A30 represents Arg, Gly or a deletion;
A31 represents Pro or a deletion;
A32 represents Ser or a deletion;
A33 represents Ser or a deletion;
A34 represents Gly or a deletion;
A35 represents Ala or a deletion;
A36 represents Pro or a deletion;
A37 represents Pro or a deletion;
A38 represents Pro or a deletion;
A39 represents Lys, Ser or a deletion;
A40 represents Arg, Lys, or a deletion, and
any one or two amino acids selected from A12, A14 and A17 optionally represent Lys(R), and R represents a substituent group,
or a salt thereof.

[9] The peptide according to [1], wherein R represents X-L-, L represents a bivalent linker comprising PEG and/or amino acid, and X represents a substituent group, or a salt thereof.

[10] The peptide according to [1], wherein R represents X-L-, L represents a bond or a bivalent substituent group, and X represents an optionally substituted hydrocarbon group, or a salt thereof.

[11] The peptide according to [1] represented by formula:
H-Tyr-Aib-Glu-Gly-Thr-Val-Val-Ser-Leu-Tyr-Ser-Ile- Aib-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys-NH$_2$(SEQ ID NO: 12), or a salt thereof.

[12] The peptide according to [1] represented by formula: H-Tyr-Aib-Glu-Gly-Thr-Val-Val-Ser-Leu-Tyr-Ser-Ile-Aib-Leu-Asp-Arg-Gln-Ala-Gln-Aib-Glu-Phe-Val-Arg-Trp-Leu-Leu-Arg-Gly-Gly-Pro-Ser-Ser-Gly-Ala-Pro-Pro-Pro-Ser-Arg-NH$_2$(SEQ ID NO: 36), or a salt thereof.

[13] The peptide according to [1] represented by formula: Me-Tyr-Aib-Glu-Gly-Thr-Phe-Ile-Ser-Asp-Tyr-Ser-Ile-Ala-Leu-Asp-Arg-Ile-Ala-Gln-Gln-Asp-Phe-Val-Asn-Trp-Leu-Leu-Ala-Gln-Arg-Pro-Ser-Ser-Gly-Ala-Pro-Pro-Pro-Ser-Arg-NH$_2$(SEQ ID NO: 65), or a salt thereof.

[14] The peptide according to [1] represented by formula: Me-Tyr-Aib-Glu-Gly-Thr-Iva-Ile-Ser-Asp-Tyr-Ser-Ile-Ala-Leu-Asp-Arg-Aib-Ala-Gln-Aib-Asn-Phe-Val-Asn-Trp-Leu-Leu-Ala-Gln-Arg-Pro-Ser-Ser-Gly-Ala-Pro-Pro-Pro-Ser-Arg-NH$_2$ (SEQ ID NO: 110), or a salt thereof.

[15] The peptide according to [1] represented by formula: Me-Tyr-Aib-Glu-Gly-Thr-Iva-Ile-Ser-Asp-Tyr-Ser-Ile-Aib-Leu-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$(SEQ ID NO: 119), or a salt thereof.

[16] The peptide according to [1] represented by formula: Me-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$(SEQ ID NO: 123), or a salt thereof.

[17] The peptide according to [1] represented by formula: Me-Tyr-Aib-Glu-Gly-Thr-Iva-Ile-Ser-Asp-Tyr-Ser-Ile-Aib-Lys(Eda-GGGGG-)-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$ (SEQ ID NO: 354), wherein R represents a substituent group, or a salt thereof.

[18] The peptide according to [1] represented by formula: Me-Tyr-Aib-Glu-Gly-Thr-Iva-Ile-Ser-Asp-Tyr-Ser-Ile-Aib-Leu-Asp-Arg-Lys(Oda-GGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$ (SEQ ID NO: 362), wherein R represents a substituent group, or a salt thereof.

[19] A medicament comprising the peptide according to [1], or a salt thereof.

[20] The medicament according to [19], which is an activator of a GIP receptor.

[21] The medicament according to [19], which is a suppressant for vomiting or nausea.

[22] A method for suppressing vomiting or nausea in a mammal, comprising administering an effective amount of the peptide of [1] or a salt thereof to the mammal.

[23] A method for activating a GIP receptor in a mammal, comprising administering an effective amount of the peptide of [1] or a salt thereof to the mammal.

[24] Use of the peptide of [1] or a salt thereof for the manufacture of a suppressant for vomiting or nausea.

[25] The peptide of [1] or a salt thereof for use in suppressing vomiting or nausea.

[26] The medicament of [21], the method of [22], the use of [24], or the peptide of [25], where the vomiting or the nausea is caused by one or more conditions or causes selected from the following (1) to (6):

(1) diseases such as gastroparesis, gastrointestinal hypomotility, peritonitis, abdominal tumor, constipation, gastrointestinal obstruction, cyclic vomiting syndrome, chronic unexplained nausea and vomiting, acute and chronic pancreatitis, hyperkalemia, cerebral edema, intracranial lesion, metabolic disorder, gastritis caused by an infection, postoperative disease, myocardial infarction, migraine, intracranial hypertension, and intracranial hypotension (e.g., altitude sickness);

(2) drugs such as (i) alkylating agents (e.g., cyclophosphamide, carmustine, lomustine, chlorambucil, streptozocin, dacarbazine, ifosfamide, temozolomide, busulfan, bendamustine, and melphalan), cytotoxic antibiotics (e.g., dactinomycin, doxorubicin, mitomycin-C, bleomycin, epirubicin, actinomycin D, amrubicin, idarubicin, daunorubicin, and pirarubicin), antimetabolic agents (e.g., cytarabine, methotrexate, 5-fluorouracil, enocitabine, and clofarabine), vinca alkaloids (e.g., etoposide, vinblastine, and vincristine), other chemotherapeutic agents such as cisplatin, procarbazine, hydroxyurea, azacytidine, irinotecan, interferon a, interleukin-2, oxaliplatin, carboplatin, nedaplatin, and miriplatin; (ii) opioid analgesics (e.g., morphine); (iii) dopamine receptor D1D2 agonists (e.g., apomorphine); (iv) cannabis and cannabinoid products including cannabis hyperemesis syndrome (3) radiation sickness or radiation therapy for the chest, the abdomen, or the like used to treat cancers;

(4) a poisonous substance or a toxin;

(5) pregnancy including hyperemesis gravidarium; and (6) a vestibular disorder such as motion sickness or dizziness.

This description includes all or part of the contents as disclosed in the description and/or drawings of Japanese Patent Application No. 2017-072556, from which the present application claims the priority.

All publications, patents, and patent applications cited herein are incorporated herein by reference in their entirety.

Advantageous Effects of Invention

Compound (I) selectively activates the GIP receptor and demonstrates a significant hypoglycemic action and antiemetic action in vivo.

BRIEF DESCRIPTION OF DRAWINGS

FIG. 3 illustrates the dose-dependent effect of Compound 6 on a morphine-induced vomiting model (ferret).

FIG. 4 illustrates the effects of Compounds 75, 104, and 117 (1 nmol/kg) and Compound 59 (3 nmol/kg) on morphine-induced vomiting in ferrets when subcutaneously administered.

FIG. 5 illustrates the effects of Compounds 59 and 113 on morphine-induced vomiting in ferrets when subcutaneously administered.

FIG. 6B illustrates the effects of Compounds 341 and 349 on morphine-induced vomiting in ferrets when subcutaneously administered. It shows results of morphine administrations 120 hours after each compound administration. Each value indicates mean±SD (n=4).

FIG. 7B illustrates the suppression of PYY-1119-induced vomiting by Compound 117 administration in beagles.

Figure 8A:
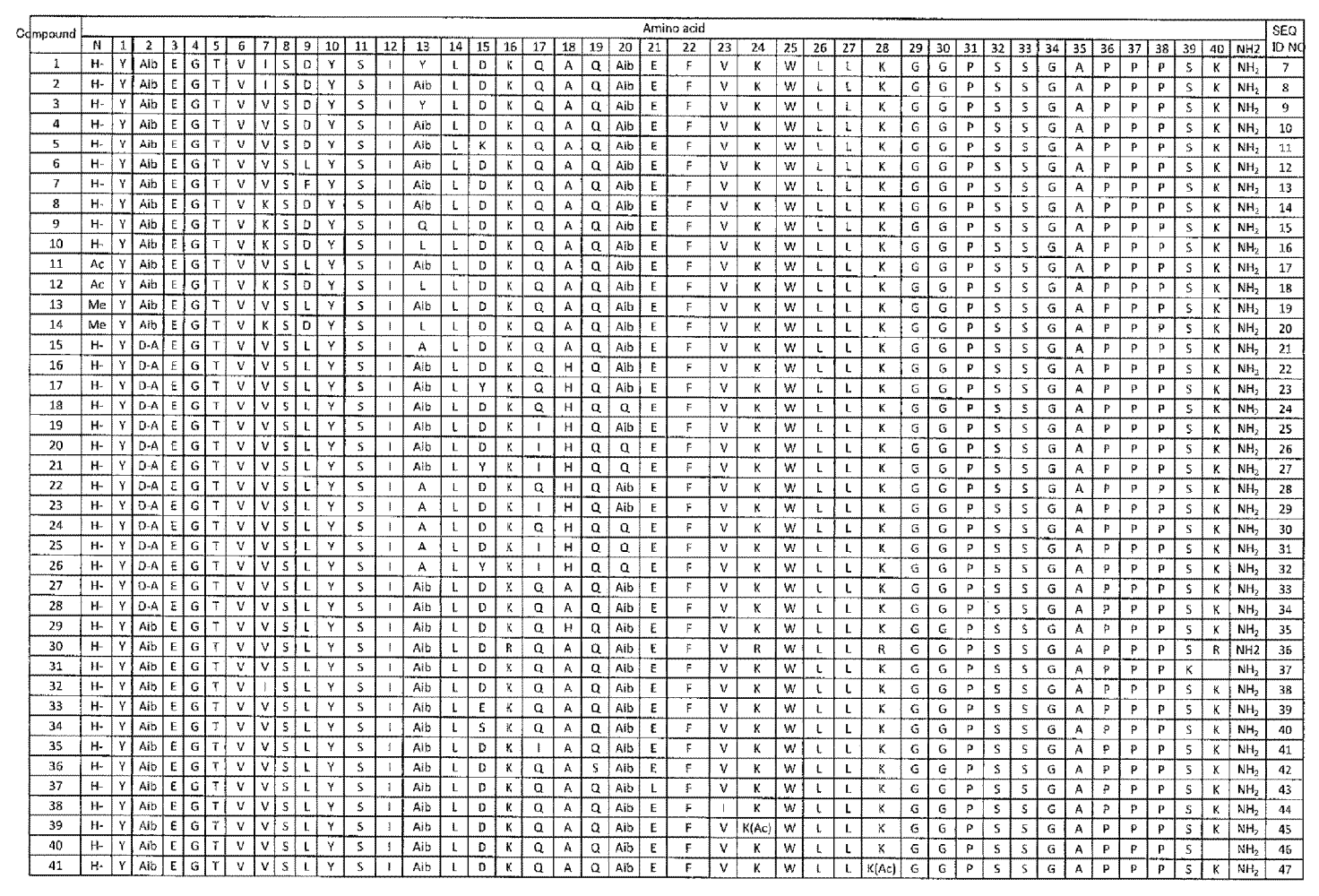
Figure 8B:
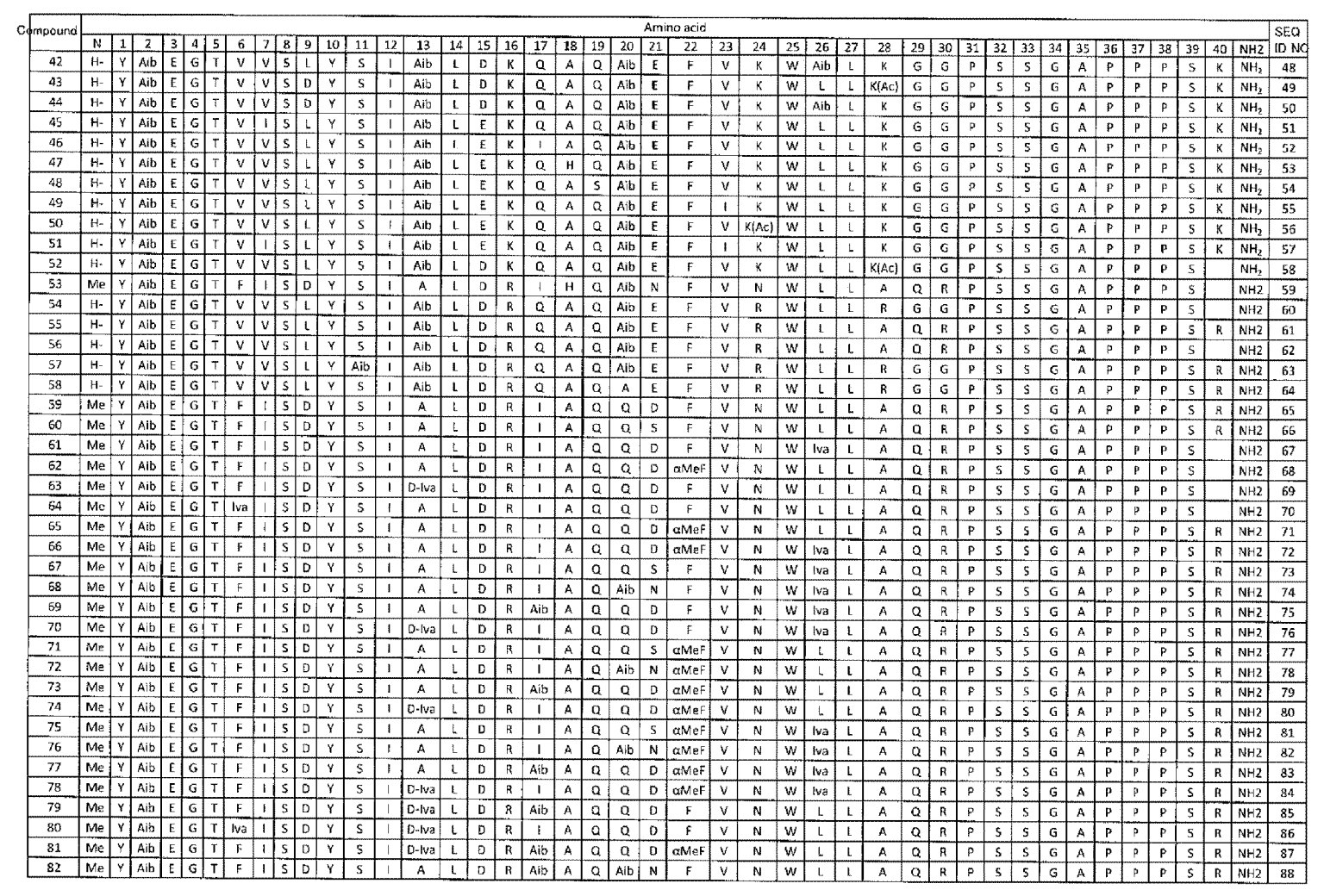

FIG. 8A illustrates an amino acid sequence of the compound according to the present invention.

FIG. 8B illustrates an amino acid sequence of the compound according to the present invention.

FIG. 8C illustrates an amino acid sequence of the compound according to the present invention.

FIG. 8D illustrates an amino acid sequence of the compound according to the present invention.

FIGS. 9A, 9B, 9C illustrate amino acid sequences of Compounds 158 to 230 according to the present invention. FIG. 9A illustrates from N-terminal to position 13 of the sequences.

FIGS. 9A, 9B, 9C illustrate amino acid sequences of Compounds 158 to 230 according to the present invention. FIG. 9B illustrates from positions 14 to 22 of the sequences which are continuous from FIG. 9A.

FIGS. 9A, 9B, 9C illustrate amino acid sequences of Compounds 158 to 230 according to the present invention. FIG. 9C illustrates from position 23 to C-terminal of the sequences which are continuous from FIG. 9B.

FIGS. 9D, 9E, 9F illustrate amino acid sequences of Compounds 231 to 303 according to the present invention. FIG. 9D illustrates from N-terminal to position 13 of the sequences.

FIGS. 9D, 9E, 9F illustrate amino acid sequences of Compounds 231 to 303 according to the present invention. FIG. 9E illustrates form positions 14 to 22 of the sequences which are continuous from FIG. 9D.

FIGS. 9D, 9E, 9F illustrate amino acid sequences of Compounds 231 to 303 according to the present invention. FIG. 9F illustrates from position 23 to C-terminal of the sequences which are continuous from FIG. 9E.

FIGS. 9G, 9H, 9I illustrate amino acid sequences of Compounds 304 to 376 according to the present invention. FIG. 9G illustrates from N-terminal to position 13 of the sequences.

FIGS. 9G, 9H, 9I illustrate amino acid sequences of Compounds 304 to 376 according to the present invention. FIG. 9H illustrates form positions 14 to 22 of the sequences which are continuous from FIG. 9G.

FIGS. 9G, 9H, 9I illustrate amino acid sequences of Compounds 304 to 376 according to the present invention. FIG. 9I illustrates from position 23 to C-terminal of the sequences which are continuous from FIG. 9H.

FIGS. 9J, 9K, 9L illustrate amino acid sequences of Compounds 377 to 449 according to the present invention. FIG. 9J illustrates from N-terminal to position 13 of the sequences.

FIGS. 9J, 9K, 9L illustrate amino acid sequences of Compounds 377 to 449 according to the present invention. FIG. 9K illustrates form positions 14 to 22 of the sequences which are continuous from FIG. 9J.

FIGS. 9J, 9K, 9L illustrate amino acid sequences of Compounds 377 to 449 according to the present invention. FIG. 9L illustrates from position 23 to C-terminal of the sequences which are continuous from FIG. 9K.

FIGS. 9M, 9N, 9O illustrate amino acid sequences of Compounds 450 to 522 according to the present invention. FIG. 9M illustrates from N-terminal to position 13 of the sequences.

FIGS. 9M, 9N, 9O illustrate amino acid sequences of Compounds 450 to 522 according to the present invention. FIG. 9N illustrates form positions 14 to 22 of the sequences which are continuous from FIG. 9M.

FIGS. 9M, 9N, 9O illustrate amino acid sequences of Compounds 450 to 522 according to the present invention. FIG. 9O illustrates from position 23 to C-terminal of the sequences which are continuous from FIG. 9N.

DETAILED DESCRIPTION OF THE INVENTION

Figure 1A:
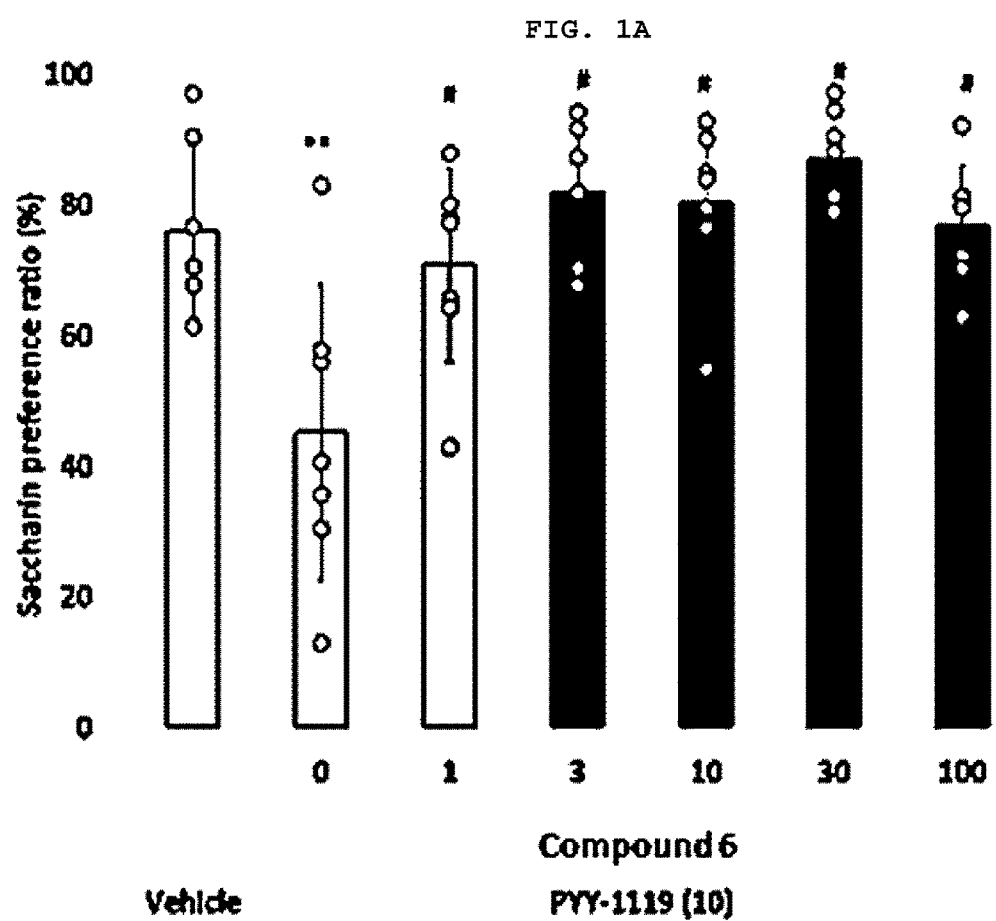
FIG. 1A illustrates the effect of Compound 6 on conditioned taste aversion (CTA) in mice.

The definition of each substituent used in the present specification is described in detail in the following. Unless otherwise specified, each substituent has the following definition.

In the present specification, examples of the "halogen atom" include fluorine, chlorine, bromine and iodine.

In the present specification, examples of the "$C_{1-6}$ alkyl group" include methyl, ethyl, propyl, isopropyl, butyl, isobutyl, sec-butyl, tert-butyl, pentyl, isopentyl, neopentyl, 1-ethylpropyl, hexyl, isohexyl, 1,1-dimethylbutyl, 2,2-dimethylbutyl, 3,3-dimethylbutyl and 2-ethylbutyl.

In the present specification, examples of the "optionally halogenated $C_{1-6}$ alkyl group" include a $C_{1-6}$ alkyl group optionally having 1 to 7, preferably 1 to 5, halogen atoms. Specific examples thereof include methyl, chloromethyl, difluoromethyl, trichloromethyl, trifluoromethyl, ethyl, 2-bromoethyl, 2,2,2-trifluoroethyl, tetrafluoroethyl, pentafluoroethyl, propyl, 2,2-difluoropropyl, 3,3,3-trifluoropropyl, isopropyl, butyl, 4,4,4-trifluorobutyl, isobutyl, sec-butyl, tert-butyl, pentyl, isopentyl, neopentyl, 5,5,5-trifluoropentyl, hexyl and 6,6,6-trifluorohexyl.

In the present specification, examples of the "$C_{2-6}$ alkenyl group" include ethenyl, 1-propenyl, 2-propenyl, 2-methyl-1-propenyl, 1-butenyl, 2-butenyl, 3-butenyl, 3-methyl-2-butenyl, 1-pentenyl, 2-pentenyl, 3-pentenyl, 4-pentenyl, 4-methyl-3-pentenyl, 1-hexenyl, 3-hexenyl and 5-hexenyl.

In the present specification, examples of the "$C_{2-6}$ alkynyl group" include ethynyl, 1-propynyl, 2-propynyl, 1-butynyl, 2-butynyl, 3-butynyl, 1-pentynyl, 2-pentynyl, 3-pentynyl, 4-pentynyl, 1-hexynyl, 2-hexynyl, 3-hexynyl, 4-hexynyl, 5-hexynyl and 4-methyl-2-pentynyl.

In the present specification, examples of the "$C_{3-10}$ cycloalkyl group" include cyclopropyl, cyclobutyl, cyclopentyl, cyclohexyl, cycloheptyl, cyclooctyl, bicyclo[2.2.1]heptyl, bicyclo[2.2.2] octyl, bicyclo[3.2.1] octyl and adamantyl.

In the present specification, examples of the "optionally halogenated $C_{3-10}$ cycloalkyl group" include a $C_{3-10}$ cycloalkyl group optionally having 1 to 7, preferably 1 to 5, halogen atoms. Specific examples thereof include cyclopropyl, 2,2-difluorocyclopropyl, 2,3-difluorocyclopropyl, cyclobutyl, difluorocyclobutyl, cyclopentyl, cyclohexyl, cycloheptyl and cyclooctyl.

In the present specification, examples of the "$C_{3-10}$ cycloalkenyl group" include cyclopropenyl, cyclobutenyl, cyclopentenyl, cyclohexenyl, cycloheptenyl and cyclooctenyl.

In the present specification, examples of the "$C_{6-14}$ aryl group" include phenyl, 1-naphthyl, 2-naphthyl, 1-anthryl, 2-anthryl and 9-anthryl.

In the present specification, examples of the "$C_{7-16}$ aralkyl group" include benzyl, phenethyl, naphthylmethyl and phenylpropyl.

In the present specification, examples of the "$C_{1-6}$ alkoxy group" include methoxy, ethoxy, propoxy, isopropoxy, butoxy, isobutoxy, sec-butoxy, tert-butoxy, pentyloxy and hexyloxy.

In the present specification, examples of the "optionally halogenated $C_{1-6}$ alkoxy group" include a $C_{1-6}$ alkoxy group optionally having 1 to 7, preferably 1 to 5, halogen atoms. Specific examples thereof include methoxy, difluoromethoxy, trifluoromethoxy, ethoxy, 2,2,2-trifluoroethoxy, propoxy, isopropoxy, butoxy, 4,4,4-trifluorobutoxy, isobutoxy, sec-butoxy, pentyloxy and hexyloxy.

In the present specification, examples of the "$C_{3-10}$ cycloalkyloxy group" include cyclopropyloxy, cyclobutyloxy, cyclopentyloxy, cyclohexyloxy, cycloheptyloxy and cyclooctyloxy.

In the present specification, examples of the "$C_{1-6}$ alkylthio group" include methylthio, ethylthio, propylthio, isopropylthio, butylthio, sec-butylthio, tert-butylthio, pentylthio and hexylthio.

In the present specification, examples of the "optionally halogenated $C_{1-6}$ alkylthio group" include a $C_{1-6}$ alkylthio group optionally having 1 to 7, preferably 1 to 5, halogen atoms. Specific examples thereof include methylthio, difluoromethylthio, trifluoromethylthio, ethylthio, propylthio, isopropylthio, butylthio, 4,4,4-trifluorobutylthio, pentylthio and hexylthio.

In the present specification, examples of the "$C_{1-6}$ alkyl-carbonyl group" include acetyl, propanoyl, butanoyl, 2-methylpropanoyl, pentanoyl, 3-methylbutanoyl, 2-methylbutanoyl, 2,2-dimethylpropanoyl, hexanoyl and heptanoyl.

In the present specification, examples of the "optionally halogenated $C_{1-6}$ alkyl-carbonyl group" include a $C_{1-6}$ alkyl-carbonyl group optionally having 1 to 7, preferably 1 to 5, halogen atoms. Specific examples thereof include acetyl, chloroacetyl, trifluoroacetyl, trichloroacetyl, propanoyl, butanoyl, pentanoyl and hexanoyl.

In the present specification, examples of the "$C_{1-6}$ alkoxy-carbonyl group" include methoxycarbonyl, ethoxycarbonyl, propoxycarbonyl, isopropoxycarbonyl, butoxycarbonyl, isobutoxycarbonyl, sec-butoxycarbonyl, tert-butoxycarbonyl, pentyloxycarbonyl and hexyloxycarbonyl.

In the present specification, examples of the "$C_{6-14}$ arylcarbonyl group" include benzoyl, 1-naphthoyl and 2-naphthoyl.

In the present specification, examples of the "$C_{7-16}$ aralkyl-carbonyl group" include phenylacetyl and phenylpropionyl.

In the present specification, examples of the "5-to 14-membered aromatic heterocyclylcarbonyl group" include nicotinoyl, isonicotinoyl, thenoyl and furoyl.

In the present specification, examples of the "3-to 14-membered non-aromatic heterocyclylcarbonyl group" include morpholinylcarbonyl, piperidinylcarbonyl and pyrrolidinylcarbonyl.

In the present specification, examples of the "mono- or di-$C_{1-6}$ alkyl-carbamoyl group" include methylcarbamoyl, ethylcarbamoyl, dimethylcarbamoyl, diethylcarbamoyl and N-ethyl-N-methylcarbamoyl.

In the present specification, examples of the "mono- or di-$C_{7-16}$ aralkyl-carbamoyl group" include benzylcarbamoyl and phenethylcarbamoyl.

In the present specification, examples of the "$C_{1-6}$ alkylsulfonyl group" include methylsulfonyl, ethylsulfonyl, propylsulfonyl, isopropylsulfonyl, butylsulfonyl, sec-butylsulfonyl and tert-butylsulfonyl.

In the present specification, examples of the "optionally halogenated $C_{1-6}$ alkylsulfonyl group" include a $C_{1-6}$ alkylsulfonyl group optionally having 1 to 7, preferably 1 to 5, halogen atoms. Specific examples thereof include methylsulfonyl, difluoromethylsulfonyl, trifluoromethylsulfonyl, ethylsulfonyl, propylsulfonyl, isopropylsulfonyl, butylsulfonyl, 4,4,4-trifluorobutylsulfonyl, pentylsulfonyl and hexylsulfonyl.

In the present specification, examples of the "$C_{6-14}$ arylsulfonyl group" include phenylsulfonyl, 1-naphthylsulfonyl and 2-naphthylsulfonyl.

In the present specification, examples of the "substituent" include a halogen atom, a cyano group, a nitro group, an optionally substituted hydrocarbon group, an optionally substituted heterocyclic group, an acyl group, an optionally substituted amino group, an optionally substituted carbamoyl group, an optionally substituted thiocarbamoyl group, an optionally substituted sulfamoyl group, an optionally substituted hydroxy group, an optionally substituted sulfanyl (SH) group and an optionally substituted silyl group.

In the present specification, examples of the "hydrocarbon group" (including "hydrocarbon group" of "optionally substituted hydrocarbon group") include a $C_{1-6}$ alkyl group, a $C_{2-6}$ alkenyl group, a $C_{2-6}$ alkynyl group, a $C_{3-10}$ cycloalkyl group, a $C_{3-10}$ cycloalkenyl group, a $C_{6-14}$ aryl group and a $C_{7-16}$ aralkyl group.

In the present specification, examples of the "optionally substituted hydrocarbon group" include a hydrocarbon group optionally having substituent(s) selected from the following substituent group A. [substituent group A]
(1) a halogen atom,
(2) a nitro group,
(3) a cyano group,
(4) an oxo group,
(5) a hydroxy group,
(6) an optionally halogenated $C_{1-6}$ alkoxy group,
(7) a $C_{6-14}$ aryloxy group (e.g., phenoxy, naphthoxy),
(8) a $C_{7-16}$ aralkyloxy group (e.g., benzyloxy),
(9) a 5-to 14-membered aromatic heterocyclyloxy group (e.g., pyridyloxy),
(10) a 3-to 14-membered non-aromatic heterocyclyloxy group (e.g., morpholinyloxy, piperidinyloxy),
(11) a $C_{1-6}$ alkyl-carbonyloxy group (e.g., acetoxy, propanoyloxy),
(12) a $C_{6-14}$ aryl-carbonyloxy group (e.g., benzoyloxy, 1-naphthoyloxy, 2-naphthoyloxy),
(13) a $C_{1-6}$ alkoxy-carbonyloxy group (e.g., methoxycarbonyloxy, ethoxycarbonyloxy, propoxycarbonyloxy, butoxycarbonyloxy),
(14) a mono- or di-$C_{1-6}$ alkyl-carbamoyloxy group (e.g., methylcarbamoyloxy, ethylcarbamoyloxy, dimethylcarbamoyloxy, diethylcarbamoyloxy),
(15) a $C_{6-14}$ aryl-carbamoyloxy group (e.g., phenylcarbamoyloxy, naphthylcarbamoyloxy),
(16) a 5-to 14-membered aromatic heterocyclylcarbonyloxy group (e.g., nicotinoyloxy),
(17) a 3-to 14-membered non-aromatic heterocyclylcarbonyloxy group (e.g., morpholinylcarbonyloxy, piperidinylcarbonyloxy),
(18) an optionally halogenated $C_{1-6}$ alkylsulfonyloxy group (e.g., methylsulfonyloxy, trifluoromethylsulfonyloxy),

(19) a $C_{6-14}$ arylsulfonyloxy group optionally substituted by a $C_{1-6}$ alkyl group (e.g., phenylsulfonyloxy, toluenesulfonyloxy),
(20) an optionally halogenated $C_{1-6}$ alkylthio group,
(21) a 5-to 14-membered aromatic heterocyclic group,
(22) a 3-to 14-membered non-aromatic heterocyclic group,
(23) a formyl group,
(24) a carboxy group,
(25) an optionally halogenated $C_{1-6}$ alkyl-carbonyl group,
(26) a $C_{6-14}$ aryl-carbonyl group,
(27) a 5-to 14-membered aromatic heterocyclylcarbonyl group,
(28) a 3-to 14-membered non-aromatic heterocyclylcarbonyl group,
(29) a $C_{1-6}$ alkoxy-carbonyl group,
(30) a $C_{6-14}$ aryloxy-carbonyl group (e.g., phenyloxycarbonyl, 1-naphthyloxycarbonyl, 2-naphthyloxycarbonyl),
(31) a $C_{7-16}$ aralkyloxy-carbonyl group (e.g., benzyloxycarbonyl, phenethyloxycarbonyl),
(32) a carbamoyl group,
(33) a thiocarbamoyl group,
(34) a mono- or di-$C_{1-6}$ alkyl-carbamoyl group,
(35) a $C_{6-14}$ aryl-carbamoyl group (e.g., phenylcarbamoyl),
(36) a 5-to 14-membered aromatic heterocyclylcarbamoyl group (e.g., pyridylcarbamoyl, thienylcarbamoyl),
(37) a 3-to 14-membered non-aromatic heterocyclylcarbamoyl group (e.g., morpholinylcarbamoyl, piperidinylcarbamoyl),
(38) an optionally halogenated $C_{1-6}$ alkylsulfonyl group,
(39) a $C_{6-14}$ arylsulfonyl group,
(40) a 5-to 14-membered aromatic heterocyclylsulfonyl group (e.g., pyridylsulfonyl, thienylsulfonyl),
(41) an optionally halogenated $C_{1-6}$ alkylsulfinyl group,
(42) a $C_{6-14}$ arylsulfinyl group (e.g., phenylsulfinyl, 1-naphthylsulfinyl, 2-naphthylsulfinyl),
(43) a 5-to 14-membered aromatic heterocyclylsulfinyl group (e.g., pyridylsulfinyl, thienylsulfinyl),
(44) an amino group,
(45) a mono- or di-$C_{1-6}$ alkylamino group (e.g., methylamino, ethylamino, propylamino, isopropylamino, butylamino, dimethylamino, diethylamino, dipropylamino, dibutylamino, N-ethyl-N-methylamino),
(46) a mono- or di-$C_{6-14}$ arylamino group (e.g., phenylamino),
(47) a 5-to 14-membered aromatic heterocyclylamino group (e.g., pyridylamino),
(48) a $C_{7-16}$ aralkylamino group (e.g., benzylamino),
(49) a formylamino group,
(50) a $C_{1-6}$ alkyl-carbonylamino group (e.g., acetylamino, propanoylamino, butanoylamino),
(51) a ($C_{1-6}$ alkyl)($C_{1-6}$ alkyl-carbonyl)amino group (e.g., N-acetyl-N-methylamino),
(52) a $C_{6-14}$ aryl-carbonylamino group (e.g., phenylcarbonylamino, naphthylcarbonylamino),
(53) a $C_{1-6}$ alkoxy-carbonylamino group (e.g., methoxycarbonylamino, ethoxycarbonylamino, propoxycarbonylamino, butoxycarbonylamino, tert-butoxycarbonylamino),
(54) a $C_{7-16}$ aralkyloxy-carbonylamino group (e.g., benzyloxycarbonylamino),
(55) a $C_{1-6}$ alkylsulfonylamino group (e.g., methylsulfonylamino, ethylsulfonylamino),
(56) a $C_{6-14}$ arylsulfonylamino group optionally substituted by a $C_{1-6}$ alkyl group (e.g., phenylsulfonylamino, toluenesulfonylamino),
(57) an optionally halogenated $C_{1-6}$ alkyl group,
(58) a $C_{2-6}$ alkenyl group,
(59) a $C_{2-6}$ alkynyl group,
(60) a $C_{3-10}$ cycloalkyl group,
(61) a $C_{3-16}1$ cycloalkenyl group and
(62) a $C_{6-14}$ aryl group.

The number of the above-mentioned substituents in the "optionally substituted hydrocarbon group" is, for example, 1 to 5, preferably 1 to 3. When the number of the substituents is two or more, the respective substituents may be the same or different.

In the present specification, examples of the "heterocyclic group" (including "heterocyclic group" of "optionally substituted heterocyclic group") include (i) an aromatic heterocyclic group, (ii) a non-aromatic heterocyclic group and (iii) a 7-to 10-membered bridged heterocyclic group, each containing, as a ring-constituting atom besides carbon atom, 1 to 4 hetero atoms selected from a nitrogen atom, a sulfur atom and an oxygen atom.

In the present specification, examples of the "aromatic heterocyclic group" (including "5-to 14-membered aromatic heterocyclic group") include a 5-to 14-membered (preferably 5-to 10-membered) aromatic heterocyclic group containing, as a ring-constituting atom besides carbon atom, 1 to 4 hetero atoms selected from a nitrogen atom, a sulfur atom and an oxygen atom.

Preferable examples of the "aromatic heterocyclic group" include 5-or 6-membered monocyclic aromatic heterocyclic groups such as thienyl, furyl, pyrrolyl, imidazolyl, pyrazolyl, thiazolyl, isothiazolyl, oxazolyl, isoxazolyl, pyridyl, pyrazinyl, pyrimidinyl, pyridazinyl, 1,2,4-oxadiazolyl, 1,3,4-oxadiazolyl, 1,2,4-thiadiazolyl, 1,3,4-thiadiazolyl, triazolyl, tetrazolyl, triazinyl and the like; and 8-to 14-membered fused polycyclic (preferably bi or tricyclic) aromatic heterocyclic groups such as benzothiophenyl, benzofuranyl, benzimidazolyl, benzoxazolyl, benzisoxazolyl, benzothiazolyl, benzisothiazolyl, benzotriazolyl, imidazopyridinyl, thienopyridinyl, furopyridinyl, pyrrolopyridinyl, pyrazolopyridinyl, oxazolopyridinyl, thiazolopyridinyl, imidazopyrazinyl, imidazopyrimidinyl, thienopyrimidinyl, furopyrimidinyl, pyrrolopyrimidinyl, pyrazolopyrimidinyl, oxazolopyrimidinyl, thiazolopyrimidinyl, pyrazolotriazinyl, naphtho[2,3-b]thienyl, phenoxathiinyl, indolyl, isoindolyl, 1H-indazolyl, purinyl, isoquinolyl, quinolyl, phthalazinyl, naphthyridinyl, quinoxalinyl, quinazolinyl, cinnolinyl, carbazolyl, β-carbolinyl, phenanthridinyl, acridinyl, phenazinyl, phenothiazinyl, phenoxazinyl and the like.

In the present specification, examples of the "non-aromatic heterocyclic group" (including "3-to 14-membered non-aromatic heterocyclic group") include a 3- to 14-membered (preferably 4-to 10-membered) non-aromatic heterocyclic group containing, as a ring-constituting atom besides carbon atom, 1 to 4 hetero atoms selected from a nitrogen atom, a sulfur atom and an oxygen atom.

Preferable examples of the "non-aromatic heterocyclic group" include 3-to 8-membered monocyclic non-aromatic heterocyclic groups such as aziridinyl, oxiranyl, thiiranyl, azetidinyl, oxetanyl, thietanyl, tetrahydrothienyl, tetrahydrofuranyl, pyrrolinyl, pyrrolidinyl, imidazolinyl, imidazolidinyl, oxazolinyl, oxazolidinyl, pyrazolinyl, pyrazolidinyl, thiazolinyl, thiazolidinyl, tetrahydroisothiazolyl, tetrahydrooxazolyl, tetrahydroisooxazolyl, piperidinyl, piperazinyl, tetrahydropyridinyl, dihydropyridinyl, dihydrothiopyranyl, tetrahydropyrimidinyl, tetrahydropyridazinyl, dihydropyranyl, tetrahydropyranyl, tetrahydrothiopyranyl, morpholinyl, thiomorpholinyl, azepanyl, diazepanyl, azepinyl, oxepanyl, azocanyl, diazocanyl and the like; and 9-to 14-membered fused polycyclic (preferably bi or tricyclic) non-aromatic heterocyclic groups such as dihydrobenzofuranyl, dihydrobenzimidazolyl, dihydrobenzoxazolyl, dihydrobenzothiazolyl, dihydrobenzisothiazolyl, dihydronaphtho[2,3-b]thienyl, tetrahydroisoquinolyl, tetrahydroquinolyl, 4H-quinolizinyl, indolinyl, isoindolinyl, tetrahydrothieno[2,3-c]pyridinyl, tetrahydrobenzazepinyl, tetrahydroquinoxalinyl, tetrahydrophenanthridinyl, hexahydrophenothiazinyl, hexahydrophenoxazinyl, tetrahydrophthalazinyl, tetrahydronaphthyridinyl, tetrahydroquinazolinyl, tetrahydrocinnolinyl, tetrahydrocarbazolyl, tetrahydro-β-carbolinyl, tetrahydroacrydinyl, tetrahydrophenazinyl, tetrahydrothioxanthenyl, octahydroisoquinolyl and the like.

In the present specification, preferable examples of the "7-to 10-membered bridged heterocyclic group" include quinuclidinyl and 7-azabicyclo[2.2.1] heptanyl.

In the present specification, examples of the "nitrogen-containing heterocyclic group" include a "heterocyclic group" containing at least one nitrogen atom as a ring-constituting atom.

In the present specification, examples of the "optionally substituted heterocyclic group" include a heterocyclic group optionally having substituent(s) selected from the aforementioned substituent group A.

The number of the substituents in the "optionally substituted heterocyclic group" is, for example, 1 to 3. When the number of the substituents is two or more, the respective substituents may be the same or different.

In the present specification, examples of the "acyl group" include a formyl group, a carboxy group, a carbamoyl group, a thiocarbamoyl group, a sulfino group, a sulfo group, a sulfamoyl group and a phosphono group, each optionally having "1 or 2 substituents selected from a $C_{1-6}$ alkyl group, a $C_{2-6}$ alkenyl group, a $C_{3-10}$ cycloalkyl group, a $C_{3-10}$ cycloalkenyl group, a $C_{6-14}$ aryl group, a $C_{7-16}$ aralkyl group, a 5-to 14-membered aromatic heterocyclic group and a 3-to 14-membered non-aromatic heterocyclic group, each of which optionally has 1 to 3 substituents selected from a halogen atom, an optionally halogenated $C_{1-6}$ alkoxy group, a hydroxy group, a nitro group, a cyano group, an amino group and a carbamoyl group".

Examples of the "acyl group" also include a hydrocarbon-sulfonyl group, a heterocyclylsulfonyl group, a hydrocarbon-sulfinyl group and a heterocyclylsulfinyl group.

Here, the hydrocarbon-sulfonyl group means a hydrocarbon group-bonded sulfonyl group, the heterocyclylsulfonyl group means a heterocyclic group-bonded sulfonyl group, the hydrocarbon-sulfinyl group means a hydrocarbon group-bonded sulfinyl group and the heterocyclylsulfinyl group means a heterocyclic group-bonded sulfinyl group.

Preferable examples of the "acyl group" include a formyl group, a carboxy group, a $C_{1-6}$ alkyl-carbonyl group, a $C_{2-6}$ alkenyl-carbonyl group (e.g., crotonoyl), a $C_{3-10}$ cycloalkyl-carbonyl group (e.g., cyclobutanecarbonyl, cyclopentanecarbonyl, cyclohexanecarbonyl, cycloheptanecarbonyl), a $C_{3-10}$ cycloalkenyl-carbonyl group (e.g., 2-cyclohexenecarbonyl), a $C_{6-14}$ aryl-carbonyl group, a $C_{7-16}$ aralkyl-carbonyl group, a 5-to 14-membered aromatic heterocyclylcarbonyl group, a 3-to 14-membered non-aromatic heterocyclylcarbonyl group, a $C_{1-6}$ alkoxy-carbonyl group, a $C_{6-14}$ aryloxy-carbonyl group (e.g., phenyloxycarbonyl, naphthyloxycarbonyl), a $C_{7-16}$ aralkyloxy-carbonyl group (e.g., benzyloxycarbonyl, phenethyloxycarbonyl), a carbamoyl group, a mono- or di-$C_{1-6}$ alkyl-carbamoyl group, a mono- or di-$C_{2-6}$ alkenyl-carbamoyl group (e.g., diallylcarbamoyl), a mono- or di-$C_{3-10}$ cycloalkyl-carbamoyl group (e.g., cyclopropylcarbamoyl), a mono- or di-$C_{6-14}$ aryl-carbamoyl group (e.g., phenylcarbamoyl), a mono- or di-$C_{7-16}$ aralkyl-carbamoyl group, a 5-to 14-membered aromatic heterocyclylcarbamoyl group (e.g., pyridylcarbamoyl), a thiocarbamoyl group, a mono- or di-$C_{1-6}$ alkyl-thiocarbamoyl group (e.g., methylthiocarbamoyl, N-ethyl-N-methylthiocarbamoyl), a mono- or di-$C_{2-6}$ alkenyl-thiocarbamoyl group (e.g., diallylthiocarbamoyl), a mono- or di-$C_{3-10}$ cycloalkyl-thiocarbamoyl group (e.g., cyclopropylthiocarbamoyl, cyclohexylthiocarbamoyl), a mono- or di-$C_{6-14}$ aryl-thiocarbamoyl group (e.g., phenylthiocarbamoyl), a mono- or di-$C_{7-16}$ aralkyl-thiocarbamoyl group (e.g., benzylthiocarbamoyl, phenethylthiocarbamoyl), a 5-to 14-membered aromatic heterocyclylthiocarbamoyl group (e.g., pyridylthiocarbamoyl), a sulfino group, a $C_{1-6}$ alkylsulfinyl group (e.g., methylsulfinyl, ethylsulfinyl), a sulfo group, a $C_{1-6}$ alkylsulfonyl group, a $C_{6-14}$ arylsulfonyl group, a phosphono group and a mono- or di-$C_{1-6}$ alkyl-phosphono group (e.g., dimethylphosphono, diethylphosphono, diisopropylphosphono, dibutylphosphono).

In the present specification, examples of the "optionally substituted amino group" include an amino group optionally having "1 or 2 substituents selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5-to 14-membered aromatic heterocyclylcarbonyl group, a 3-to 14-membered non-aromatic heterocyclylcarbonyl group, a $C_{1-6}$ alkoxy-carbonyl group, a 5-to 14-membered aromatic heterocyclic group, a carbamoyl group, a mono- or di-$C_{1-6}$ alkyl-carbamoyl group, a mono- or di-$C_{7-16}$ aralkyl-carbamoyl group, a $C_{1-6}$ alkylsulfonyl group and a $C_{6-14}$ arylsulfonyl group, each of which optionally has 1 to 3 substituents selected from substituent group A".

Preferable examples of the optionally substituted amino group include an amino group, a mono- or di- (optionally halogenated $C_{1-6}$ alkyl)amino group (e.g., methylamino, trifluoromethylamino, dimethylamino, ethylamino, diethylamino, propylamino, dibutylamino), a mono- or di-$C_{2-6}$ alkenylamino group (e.g., diallylamino), a mono- or di-$C_{3-10}$ cycloalkylamino group (e.g., cyclopropylamino, cyclohexylamino), a mono- or di-$C_{6-14}$ arylamino group (e.g., phenylamino), a mono- or di-$C_{7-16}$ aralkylamino group (e.g., benzylamino, dibenzylamino), a mono- or di-(optionally halogenated $C_{1-6}$ alkyl)-carbonylamino group (e.g., acetylamino, propionylamino), a mono- or di-$C_{6-14}$ aryl-carbonylamino group (e.g., benzoylamino), a mono- or di-$C_{7-16}$ aralkyl-carbonylamino group (e.g., benzylcarbonylamino), a mono- or di-5-to 14-membered aromatic heterocyclylcarbonylamino group (e.g., nicotinoylamino, isonicotinoylamino), a mono- or di-3-to 14-membered non-aromatic heterocyclylcarbonylamino group (e.g., piperidinylcarbonylamino), a mono- or di-$C_{1-6}$ alkoxy-carbonylamino group (e.g., tert-butoxycarbonylamino), a 5-to 14-membered aromatic heterocyclylamino group (e.g., pyridylamino), a carbamoylamino group, a (mono- or di-$C_{1-6}$ alkyl-carbamoyl) amino group (e.g., methylcarbamoylamino), a (mono- or di-$C_{7-16}$ aralkyl-carbamoyl)amino group (e.g., benzylcarbamoylamino), a $C_{1-6}$ alkylsulfonylamino group (e.g., methylsulfonylamino, ethylsulfonylamino), a $C_{6-14}$ arylsulfonylamino group (e.g., phenylsulfonylamino), a ($C_{1-6}$ alkyl) ($C_{1-6}$ alkyl-carbonyl)amino group (e.g., N-acetyl-N-methylamino) and a ($C_{1-6}$ alkyl) ($C_{6-14}$ aryl-carbonyl)amino group (e.g., N-benzoyl-N-methylamino).

In the present specification, examples of the "optionally substituted carbamoyl group" include a carbamoyl group optionally having "1 or 2 substituents selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5-to 14-membered aromatic heterocyclylcarbonyl group, a 3-to 14-membered non-aromatic heterocyclylcarbonyl group, a $C_{1-6}$ alkoxy-carbonyl group, a 5-to 14-membered aromatic heterocyclic group, a carbamoyl group, a mono- or di-$C_{1-6}$ alkyl-carbamoyl group and a mono- or di-$C_{7-16}$ aralkyl-carbamoyl group, each of which optionally has 1 to 3 substituents selected from substituent group A".

Preferable examples of the optionally substituted carbamoyl group include a carbamoyl group, a mono- or di-$C_{1-6}$ alkyl-carbamoyl group, a mono- or di-$C_{2-6}$ alkenyl-carbamoyl group (e.g., diallylcarbamoyl), a mono- or di-$C_{3-10}$ cycloalkyl-carbamoyl group (e.g., cyclopropylcarbamoyl, cyclohexylcarbamoyl), a mono- or di-$C_{6-14}$ aryl-carbamoyl group (e.g., phenylcarbamoyl), a mono- or di-$C_{7-16}$ aralkyl-carbamoyl group, a mono- or di-$C_{1-6}$ alkyl-carbonyl-carbamoyl group (e.g., acetylcarbamoyl, propionylcarbamoyl), a mono- or di-$C_{6-14}$ aryl-carbonyl-carbamoyl group (e.g., benzoylcarbamoyl) and a 5- to 14-membered aromatic heterocyclylcarbamoyl group (e.g., pyridylcarbamoyl).

In the present specification, examples of the "optionally substituted thiocarbamoyl group" include a thiocarbamoyl group optionally having "1 or 2 substituents selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5- to 14-membered aromatic heterocyclylcarbonyl group, a 3- to 14-membered non-aromatic heterocyclylcarbonyl group, a $C_{1-6}$ alkoxy-carbonyl group, a 5-to 14-membered aromatic heterocyclic group, a carbamoyl group, a mono- or di-$C_{1-6}$ alkyl-carbamoyl group and a mono- or di-$C_{7-16}$ aralkyl-carbamoyl group, each of which optionally has 1 to 3 substituents selected from substituent group A".

Preferable examples of the optionally substituted thiocarbamoyl group include a thiocarbamoyl group, a mono- or di-$C_{1-6}$ alkyl-thiocarbamoyl group (e.g., methylthiocarbamoyl, ethylthiocarbamoyl, dimethylthiocarbamoyl, diethylthiocarbamoyl, N-ethyl-N-methylthiocarbamoyl), a mono- or di-$C_{2-6}$ alkenyl-thiocarbamoyl group (e.g., diallylthiocarbamoyl), a mono- or di-$C_{3-10}$ cycloalkyl-thiocarbamoyl group (e.g., cyclopropylthiocarbamoyl, cyclohexylthiocarbamoyl), a mono- or di-$C_{6-14}$ aryl-thiocarbamoyl group (e.g., phenylthiocarbamoyl), a mono- or di-$C_{7-16}$ aralkyl-thiocarbamoyl group (e.g., benzylthiocarbamoyl, phenethylthiocarbamoyl), a mono- or di-$C_{1-6}$ alkyl-carbonyl-thiocarbamoyl group (e.g., acetylthiocarbamoyl, propionylthiocarbamoyl), a mono- or di-$C_{6-14}$ aryl-carbonyl-thiocarbamoyl group (e.g., benzoylthiocarbamoyl) and a 5-to 14-membered aromatic heterocyclylthiocarbamoyl group (e.g., pyridylthiocarbamoyl).

In the present specification, examples of the "optionally substituted sulfamoyl group" include a sulfamoyl group optionally having "1 or 2 substituents selected from a $C_{1-6}$ alkyl group, a $C_{2-6}$ alkenyl group, a $C_{3-1}°$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5-to 14-membered aromatic heterocyclylcarbonyl group, a 3-to 14-membered non-aromatic heterocyclylcarbonyl group, a $C_{1-6}$ alkoxy-carbonyl group, a 5-to 14-membered aromatic heterocyclic group, a carbamoyl group, a mono- or di-$C_{1-6}$ alkyl-carbamoyl group and a mono- or di-$C_{7-16}$ aralkyl-carbamoyl group, each of which optionally has 1 to 3 substituents selected from substituent group A".

Preferable examples of the optionally substituted sulfamoyl group include a sulfamoyl group, a mono- or di-$C_{1-6}$ alkyl-sulfamoyl group (e.g., methylsulfamoyl, ethylsulfamoyl, dimethylsulfamoyl, diethylsulfamoyl, N-ethyl-N-methylsulfamoyl), a mono- or di-$C_{2-6}$ alkenyl-sulfamoyl group (e.g., diallylsulfamoyl), a mono- or di-$C_{3-10}$ cycloalkyl-sulfamoyl group (e.g., cyclopropylsulfamoyl, cyclohexylsulfamoyl), a mono- or di-$C_{6-14}$ aryl-sulfamoyl group (e.g., phenylsulfamoyl), a mono- or di-$C_{7-16}$ aralkyl-sulfamoyl group (e.g., benzylsulfamoyl, phenethylsulfamoyl), a mono- or di-$C_{1-6}$ alkyl-carbonyl-sulfamoyl group (e.g., acetylsulfamoyl, propionylsulfamoyl), a mono- or di-$C_{6-14}$ aryl-carbonyl-sulfamoyl group (e.g., benzoylsulfamoyl) and a 5-to 14-membered aromatic heterocyclylsulfamoyl group (e.g., pyridylsulfamoyl).

In the present specification, examples of the "optionally substituted hydroxy group" include a hydroxyl group optionally having "a substituent selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group, a $C_{7-16}$ aralkyl-carbonyl group, a 5-to 14-membered aromatic heterocyclylcarbonyl group, a 3-to 14-membered non-aromatic heterocyclylcarbonyl group, a $C_{1-6}$ alkoxy-carbonyl group, a 5-to 14-membered aromatic heterocyclic group, a carbamoyl group, a mono- or di-$C_{1-6}$ alkyl-carbamoyl group, a mono- or di-$C_{7-16}$ aralkyl-carbamoyl group, a $C_{1-6}$ alkylsulfonyl group and a $C_{6-14}$ arylsulfonyl group, each of which optionally has 1 to 3 substituents selected from substituent group A".

Preferable examples of the optionally substituted hydroxy group include a hydroxy group, a $C_{1-6}$ alkoxy group, a $C_{2-6}$ alkenyloxy group (e.g., allyloxy, 2-butenyloxy, 2-pentenyloxy, 3-hexenyloxy), a $C_{3-10}$ cycloalkyloxy group (e.g., cyclohexyloxy), a $C_{6-14}$ aryloxy group (e.g., phenoxy, naphthyloxy), a $C_{7-16}$ aralkyloxy group (e.g., benzyloxy, phenethyloxy), a $C_{1-6}$ alkyl-carbonyloxy group (e.g., acetyloxy, propionyloxy, butyryloxy, isobutyryloxy, pivaloyloxy), a $C_{6-14}$ aryl-carbonyloxy group (e.g., benzoyloxy), a $C_{7-16}$ aralkyl-carbonyloxy group (e.g., benzylcarbonyloxy), a 5-to 14-membered aromatic heterocyclylcarbonyloxy group (e.g., nicotinoyloxy), a 3- to 14-membered non-aromatic heterocyclylcarbonyloxy group (e.g., piperidinylcarbonyloxy), a $C_{1-6}$ alkoxy-carbonyloxy group (e.g., tert-butoxycarbonyloxy), a 5-to 14-membered aromatic heterocycloxy group (e.g., pyridyloxy), a carbamoyloxy group, a $C_{1-6}$ alkyl-carbamoyloxy group (e.g., methylcarbamoyloxy), a $C_{7-16}$ aralkyl-carbamoyloxy group (e.g., benzylcarbamoyloxy), a $C_{1-6}$ alkylsulfonyloxy group (e.g., methylsulfonyloxy, ethylsulfonyloxy) and a $C_{6-14}$ arylsulfonyloxy group (e.g., phenylsulfonyloxy).

In the present specification, examples of the "optionally substituted sulfanyl group" include a sulfanyl group optionally having "a substituent selected from a $C_{1-6}$ alkyl group, a $C_{2-6}$ alkenyl group, a $C_{3-10}$ cycloalkyl group, a $C_{6-14}$ aryl group, a $C_{7-16}$ aralkyl group, a $C_{1-6}$ alkyl-carbonyl group, a $C_{6-14}$ aryl-carbonyl group and a 5-to 14-membered aromatic heterocyclic group, each of which optionally has 1 to 3 substituents selected from substituent group A" and a halogenated sulfanyl group.

Preferable examples of the optionally substituted sulfanyl group include a sulfanyl (—SH) group, a $C_{1-6}$ alkylthio group, a $C_{2-6}$ alkenylthio group (e.g., allylthio, 2-butenylthio, 2-pentenylthio, 3-hexenylthio), a $C_{3-10}$ cycloalkylthio group (e.g., cyclohexylthio), a $C_{6-14}$ arylthio group (e.g., phenylthio, naphthylthio), a $C_{7-16}$ aralkylthio group (e.g., benzylthio, phenethylthio), a $C_{1-6}$ alkyl-carbonylthio group (e.g., acetylthio, propionylthio, butyrylthio, isobutyrylthio, pivaloylthio), a $C_{6-14}$ aryl-carbonylthio group (e.g., benzoylthio), a 5- to 14-membered aromatic heterocyclylthio group (e.g., pyridylthio) and a halogenated thio group (e.g., pentafluorothio).

In the present specification, examples of the "optionally substituted silyl group" include a silyl group optionally having "1 to 3 substituents selected from a $C_{1-6}$ alkyl group, a $C_{2-6}$ alkenyl group, a $C_{3-10}$ cycloalkyl group, a $C_{6-14}$ aryl group and a $C_{7-16}$ aralkyl group, each of which optionally has 1 to 3 substituents selected from substituent group A".

Preferable examples of the optionally substituted silyl group include a tri-$C_{1-6}$ alkylsilyl group (e.g., trimethylsilyl, tert-butyl(dimethyl)silyl).

Regarding compound 1, the definition of each symbol in the formula (I): :$P^1$-Tyr-A2-Glu-Gly-Thr-A6-A7-A8-A9-A10-A11-A12-A13-A14-A15-A16-A17-A18-A19-A20-A21-A22-A23-A24-A25-A26-A27-A28-A29-A30-A31-A32-A33-A34-A35-A36-A37-A38-A39-A40-$P^2$ (SEQ ID NO: 165) is described in detail in the following.

$P^1$ is a group represented by the formula:

—$R^{41}$,

—CO—$R^{41}$,

—CO—O$R^{41}$,

—CO—CO$R^{41}$,

—SO—$R^{41}$,

—$SO_2$—$R^{41}$,

—$SO_2$—O$R^{41}$,

—CO—$NR^{42}R^{43}$,

—$SO_2$—$NR^{42}R^{43}$, or

—C(=$NR^{41}$)—$NR^{42}R^{43}$ wherein $R^{41}$, $R^{42}$ and $R^{43}$ are each independently a hydrogen atom, an optionally substituted hydrocarbon group, or optionally substituted heterocyclic group.

$P^1$ is preferably an acetyl group, a methyl group or a hydrogen atom.

$P^2$ represents —$NH_2$ or —OH.

A2 represents Aib or D-Ala.
A6 represents Iva, Phe or Val.
A7 represents Ile, Lys or Val.
A8 represents Ser.
A9 represents Asp, Leu or Phe.
A10 represents Tyr.
A11 represents Aib or Ser.
A12 represents Ile.
A13 represents Aib, Ala, Gln, Leu, Tyr or D-Iva.
A14 represents Leu.
A15 represents Asp, Glu, Lys, Ser or Tyr.
A16 represents Arg or Lys.
A17 represents Aib, Gln or Ile.
A18 represents Ala or His.
A19 represents Gln or Ser.
A20 represents Aib, Ala or Gln.
A21 represents Asn, Asp, Glu, Leu, or Ser.
A22 represents Phe or αMePhe.
A23 represents Ile or Val.
A24 represents Arg, Asn, Asp, Lys, or Lys(Ac).
A25 represents Trp.
A26 represents Aib, Iva, or Leu.
A27 represents Leu.
A28 represents Ala, Arg, Lys or Lys(Ac).
A29 represents Gln or Gly.
A30 represents Arg, Gly, or a deletion.
A31 represents Pro or a deletion.
A32 represents Ser or a deletion.
A33 represents Ser or a deletion.
A34 represents Gly or a deletion.
A35 represents Ala or a deletion.
A36 represents Pro or a deletion.
A37 represents Pro or a deletion.
A38 represents Pro or a deletion.
A39 represents Lys, Ser, or a deletion.
A40 represents Arg, Lys or a deletion.

Provided that where all A31 to A40 represent deletions, then A2 represents Aib.

Any one or two amino acids selected from A8 to A30 optionally represent Lys(R). R represents a substituent group.

Preferably, R represents X-L-, wherein L represents a bivalent linker comprising PEG and/or amino acid or consisting of PEG and/or amino acid, and X represents a substituent group. A Known PEG linker, an amino acid linker or combinations thereof may be used as the bivalent linker as long as it is able to link Lys to a substituent group. Alternatively, preferably, R represents X-L-, wherein L represents a bond or a bivalent substituent group, and X represents an optionally substituted hydrocarbon group, or a salt thereof. A Known bivalent substituent group including, but are not limited to, an alkylene group, a carbonyl group, an oxycarbonyl group, an imino group, an alkylimino group, a sulfonyl group, an oxy group, a sulfide group, an ester bond, an amide bond, a carbonate bond or combinations thereof may be used. More preferably, R represents X-L-, wherein L is one or a combination of more than one selected from

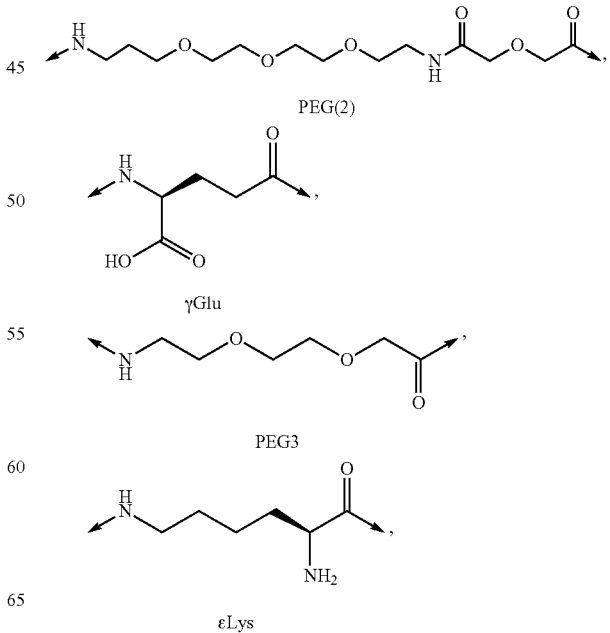

GABA

AMBZ

Tra

NpipAc a glycine linker comprising one or two to nine-linked glycine(s) or a single bond, and X represents $C_6$-$C_{20}$ monacid or diacid, or an acetyl group.

Specifically, R represents X-L-, wherein X-L- preferably represents Trda-GGGG-(Trda:C13 diacid), Trda-GGGGG-, Trda-GGGGGG-, Teda-GGGG-(Teda:C14 diacid), Teda-GGGGG-, Teda-GGGGGG-, Peda-GGGG-(Peda:C15 diadic), Peda-GGGGG-, Peda-GGGGGG-, Heda-GGGG-(Heda:C16 diacid), Heda-GGGGG-, Heda-GGGGGG-, Hepda-GGGG-(Hepda:C17 diacid), Hepda-GGGGG-, Hepda-GGGGGG-, Oda-GGGG-(Oda:C18 diacid), Oda-GGGGG-, Oda-GGGGGG-, Eda-GGGG-(Eda:C20 diacid), Eda-GGGGG-, Eda-GGGGGG-, Eda-GGGGGGGGG-.

Alternatively, particularly preferably, R represents X-L-, wherein L represents a glycine linker comprising five or six-linked glycines, and X represents $C_{16}$-$C_{20}$ linear saturated dicarboxylic acid.

Additionally, when any one or two amino acids selected from A8 to A30 optionally represent Lys(R), preferably one amino acid selected from A12, A14 and A17 represents Lys(R), and more preferably one amino acid selected from A14 and A17 represents Lys(R).

Preferable examples of Compound (I) include a peptide represented by the following formula (II) or a salt thereof.

formula (II):

$P^1$-Tyr-A2-Glu-Gly-Thr-A6-A7-A8-A9-A10-A11-
A12-A13-A14-A15-A16-A17-A18-A19-A20-
A21-A22-A23-A24-A25-A26-A27-A28-A29-
A30-Pro-Ser-Ser-Gly-Ala-Pro-Pro-Pro-A39-
A40-$P^2$ (SEQ ID NO: 166)

In the formula (II), $P^1$ is defined as above.
$P^2$ is defined as above.
A2 represents Aib or D-Ala.
A6 represents Iva, Phe, or Val.
A7 represents Ile, Lys or Val.
A8 represents Ser.
A9 represents Asp, Leu or Phe.
A10 represents Tyr.
A11 represents Aib or Ser.
A12 represents Ile.
A13 represents Aib, Ala, Gln, Leu, Tyr, or D-Iva.
A14 represents Leu.
A15 represents Asp, Glu, Lys, Ser or Tyr.
A16 represents Arg or Lys.
A17 represents Aib, Gln or Ile.
A18 represents Ala or His.
A19 represents Gln or Ser.
A20 represents Aib, Ala, or Gln.
A21 represents Asn, Asp, Glu, Leu or Ser.
A22 represents Phe or aMePhe.
A23 represents Ile or Val.
A24 represents Arg, Asn, Asp, Lys, or Lys(Ac).
A25 represents Trp.
A26 represents Aib, Iva, or Leu.
A27 represents Leu.
A28 represents Ala, Arg, Lys, or Lys(Ac).
A29 represents Gln or Gly.
A30 represents Arg or Gly.
A39 represents Lys or Ser.
A40 represents Arg, Lys or a deletion.

Any one or two amino acids selected from A8 to A30 optionally represent Lys(R), and R is defined as above.

Preferable other examples of Compound (I) include a peptide represented by the following formula (III) or a salt thereof.

formula (III):

$P^1$-Tyr-A2-Glu-Gly-Thr-Val-A7-A8-A9-A10-A11-
A12-A13-A14-A15-A16-A17-A18-A19-A20-
A21-A22-A23-A24-A25-A26-A27-A28-A29-
A30-Pro-Ser-Ser-Gly-Ala-Pro-Pro-Pro-A39-
A40-$P^2$(SEQ ID NO: 167)

In the formula (III), $P^1$ is defined as above.
$P^2$ is defined as above.
A2 represents Aib or D-Ala.
A7 represents Ile, Lys, or Val.
A8 represents Ser.
A9 represents Asp, Leu, or Phe.
A10 represents Tyr.
A11 represents Ser.
A12 represents Ile.
A13 represents Aib, Ala, Gln, Leu, or Tyr.
A14 represents Leu.
A15 represents Asp, Glu, Lys, Ser, or Tyr.
A16 represents Lys.
A17 represents Gln or Ile.
A18 represents Ala or His.
A19 represents Gln or Ser.
A20 represents Aib or Gln.
A21 represents Glu, or Leu.
A22 represents Phe.
A23 represents Ile or Val.
A24 represents Lys, or Lys(Ac).
A25 represents Trp.
A26 represents Aib, or Leu.
A27 represents Leu.
A28 represents Lys, or Lys(Ac).
A29 represents Gly.
A30 represents Gly.
A39 represents Lys, or Ser.
A40 represents Arg or a deletion.

Any one or two amino acids selected from A8 to A30 optionally represent Lys(R), and R is defined as above.

Furthermore, preferable other examples of Compound (I) include a peptide represented by the following formula (IV) or a salt thereof.

formula (IV):

$P^1$-Tyr-Aib-Glu-Gly-Thr-A6-A7-A8-A9-A10-A11-
A12-A13-A14-A15-A16-A17-A18-A19-A20-
A21-A22-A23-A24-A25-A26-A27-A28-A29-
A30-Pro-Ser-Ser-Gly-Ala-Pro-Pro-Pro-Ser-A40-
$P^2$ (SEQ ID NO: 168)

In the formula (IV), $P^1$ is defined as above.
$P^2$ is defined as above.
A6 represents Iva, Phe, or Val.
A7 represents Ile or Val.
A8 represents Ser.

A9 represents Asp or Leu.
A10 represents Tyr.
A11 represents Aib or Ser.
A12 represents Ile.
A13 represents Aib, Ala, or D-Iva.
A14 represents Leu.
A15 represents Asp.
A16 represents Arg.
A17 represents Aib, Gln, or Ile.
A18 represents Ala or His.
A19 represents Gln.
A20 represents Aib, Ala, or Gln.
A21 represents Glu, Asn, Asp, or Ser.
A22 represents Phe or αMePhe.
A23 represents Val.
A24 represents Arg, Asp or Asn.
A25 represents Trp.
A26 represents Leu or Iva.
A27 represents Leu.
A28 represents Ala or Arg.
A29 represents Gln or Gly.
A30 represents Arg or Gly.
A40 represents Arg or a deletion.
Any one or two amino acids selected from A8 to A30 optionally represent Lys(R), and R is defined as above.

Moreover, preferable other examples of Compound (I) include a peptide represented by the following formula (V) or a salt thereof.

formula (V):

P$^1$-Tyr-Aib-Glu-Gly-Thr-A6-A7-A8-A9-A10-A11-
A12-A13-A14-A15-A16-A17-A18-A19-A20-
A21-A22-A23-A24-A25-A26-A27-A28-A29-
A30-A31-A32-A33-A34-A35-A36-A37-A38-
A39-A40-P$^2$ (SEQ ID NO: 169)

In the formula (V), P$^1$ is defined as above.
P$^2$ is defined as above.
A6 represents Iva, Phe, or Val.
A7 represents Ile, Lys, or Val.
A8 represents Ser.
A9 represents Asp, Leu, or Phe.
A10 represents Tyr.
A11 represents Aib or Ser.
A12 represents Ile.
A13 represents Aib, Ala, Gln, Leu, Tyr, or D-Iva.
A14 represents Leu.
A15 represents Asp, Glu, Lys, Ser, or Tyr.
A16 represents Arg or Lys.
A17 represents Aib, Gln, or Ile.
A18 represents Ala or His.
A19 represents Gln or Ser.
A20 represents Aib, Ala, or Gln.
A21 represents Asn, Asp, Glu, Leu, or Ser.
A22 represents Phe or αMePhe.
A23 represents Ile or Val.
A24 represents Arg, Asn, Lys, or Lys(Ac).
A25 represents Trp.
A26 represents Aib, Iva, or Leu.
A27 represents Leu.
A28 represents Ala, Arg, Lys, or Lys(Ac).
A29 represents Gln or Gly.
A30 represents Arg, Gly or a deletion.
A11 A31 to A40 represent a deletion.
Any one or two amino acids selected from A8 to A30 optionally represent Lys(R), and R is defined as above.

Specifically preferable examples of Compound (I) include a peptide represented by the following formula (VI) or a salt thereof.

formula (VI):

P$^1$-Tyr-Aib-Glu-Gly-Thr-A6-A7-A8-A9-A10-A11-
A12-A13-A14-A15-A16-A17-A18-A19-A20-
A21-A22-A23-A24-A25-A26-A27-A28-A29-
A30-Pro-Ser-Ser-Gly-Ala-Pro-Pro-Pro-Ser-A40-
P$^2$ (SEQ ID NO: 170)

In the formula (VI), P$^1$ is defined as above.
P$^2$ is defined as above.
A6 represents Iva, Phe, or Val.
A7 represents Ile or Val.
A8 represents Ser.
A9 represents Asp or Leu.
A10 represents Tyr.
A11 represents Ser.
A12 represents Ile.
A13 represents Aib or Ala.
A14 represents Leu.
A15 represents Asp.
A16 represents Arg or Lys.
A17 represents Aib, Gln, or Ile.
A18 represents Ala or His.
A19 represents Gln.
A20 represents Aib, or Gln.
A21 represents Asn, Glu, or Asp.
A22 represents Phe.
A23 represents Val.
A24 represents Arg, Asn, or Lys.
A25 represents Trp.
A26 represents Iva or Leu.
A27 represents Leu.
A28 represents Ala, Arg, or Lys.
A29 represents Gln or Gly.
A30 represents Arg, or Gly.
A40 represents Arg, Lys, or a deletion.
Any one or two amino acids selected from A8 to A30 optionally represent Lys(R), and R is defined as above.

Further, preferable other examples of Compound (I) include a peptide represented by the above formula (I),
wherein P$^1$ is defined as above,
P$^2$ is defined as above,
A2 represents Aib or D-Ala,
A6 represents Iva, Phe, or Val,
A7 represents Ile, Lys, or Val,
A8 represents Ser,
A9 represents Asp, Leu, or Phe,
A10 represents Tyr,
A11 represents Aib or Ser,
A12 represents Ile,
A13 represents Aib, Ala, Gln, Leu, Tyr, or D-Iva,
A14 represents Leu,
A15 represents Asp, Glu, Lys, Ser, or Tyr,
A16 represents Arg or Lys,
A17 represents Aib, Gln, or Ile,
A18 represents Ala or His,
A19 represents Gln or Ser,
A20 represents Aib, Ala, or Gln,
A21 represents Asn, Asp, Glu, Leu, or Ser,
A22 represents Phe or αMePhe,
A23 represents Ile or Val,
A24 represents Arg, Asn, Asp, Lys, or Lys(Ac),
A25 represents Trp,
A26 represents Aib, Iva, or Leu,
A27 represents Leu,
A28 represents Ala, Arg, Lys, or Lys(Ac),
A29 represents Gln or Gly,
A30 represents Arg, Gly or a deletion,
A31 represents Pro or a deletion, A32 represents Ser or a deletion,
A33 represents Ser or a deletion,
A34 represents Gly or a deletion,
A35 represents Ala or a deletion,
A36 represents Pro or a deletion,
A37 represents Pro or a deletion,
A38 represents Pro or a deletion,
A39 represents Lys, Ser or a deletion, and
A40 represents Arg, Lys, or a deletion, or a salt thereof.

Provided that all A31 to A40 represent deletions, then A2 represents Aib.

Furthermore, preferable other examples of Compound (I) include a peptide represented by the above formula (I),
wherein $P^1$ is defined as above,
$P^2$ is defined as above,
A2 represents Aib or D-Ala,
A6 represents Iva, Phe, or Val,
A7 represents Ile, Lys, or Val,
A8 represents Ser,
A9 represents Asp, Leu, or Phe,
A10 represents Tyr,
A11 represents Aib or Ser,
A12 represents Ile,
A13 represents Aib, Ala, Gln, Leu, Tyr, or D-Iva,
A14 represents Leu,
A15 represents Asp, Glu, Lys, Ser, or Tyr,
A16 represents Arg or Lys,
A17 represents Aib, Gln, or Ile,
A18 represents Ala or His,
A19 represents Gln or Ser,
A20 represents Aib, Ala, or Gln,
A21 represents Asn, Asp, Glu, Leu, or Ser,
A22 represents Phe or αMePhe,
A23 represents Ile or Val,
A24 represents Arg, Asn, Lys, or Lys(Ac),
A25 represents Trp,
A26 represents Aib, Iva, or Leu,
A27 represents Leu,
A28 represents Ala, Arg, Lys, or Lys(Ac),
A29 represents Gln or Gly,
A30 represents Arg, Gly or a deletion,
A31 represents Pro or a deletion,
A32 represents Ser or a deletion,
A33 represents Ser or a deletion,
A34 represents Gly or a deletion,
A35 represents Ala or a deletion,
A36 represents Pro or a deletion,
A37 represents Pro or a deletion,
A38 represents Pro or a deletion,
A39 represents Lys, Ser or a deletion, and
A40 represents Arg, Lys, or a deletion,
or a salt thereof.

Provided that all A31 to A40 represent deletions, then A2 represents Aib.

Any one or two amino acids selected from A12, A14 and A17 optionally represent Lys(R), and R is defined as above.

Further more preferable other examples of Compound (I) include a peptide represented by the following formula (VII) or a salt thereof.

formula (VII):

$P^1$-Tyr-Aib-Glu-Gly-Thr-A6-A7-Ser-A9-Tyr-Ser-Ile-A13-Leu-Asp-A16-A17-A18-Gln-A20-A21-Phe-Val-A24-Trp-A26-Leu-A28-A29-A30-Pro-Ser-Ser-Gly-Ala-Pro-Pro-Pro-Ser-A40-$P^2$ (SEQ ID NO:567)

In the formula (VII), $P^1$ is defined as above.
$P^2$ is defined as above.
A6 represents Iva, Phe, or Val.
A7 represents Ile or Val.
A9 represents Asp or Leu.
A13 represents Aib or Ala.
A16 represents Arg or Lys.
A17 represents Aib, Gln, or Ile.
A18 represents Ala or His.
A20 represents Aib, or Gln.
A21 represents Asn, Glu, or Asp.
A24 represents Arg, Asn, or Lys.
A26 represents Iva or Leu.
A28 represents Ala, Arg, or Lys.
A29 represents Gln or Gly.
A30 represents Arg, or Gly.
A40 represents Arg, Lys, or a deletion.

Further more preferable other examples of Compound (I) include a peptide represented by the following formula (VIII) or a salt thereof.

formula (VIII):

$P^1$-Tyr-Aib-Glu-Gly-Thr-Iva-Ile-Ser-Asp-Tyr-Ser-Ile-Aib-Lys(R)-Asp-Arg-Aib-A18-Gln-Aib-Asn-Phe-Val-Asn-Trp-Iva-Leu-Ala-Gln-Arg-Pro-Ser-Ser-Gly-Ala-Pro-Pro-Pro-Ser-A40-$P^2$ (SEQ ID NO:568);

In the formula (VIII), $P^1$ is defined as above.
$P^2$ is defined as above.
A18 represents Ala or His.
A40 represents Arg or a deletion.
R represents X-L-.
-L- represents -GGGGG- or -GGGGGG-.
X represents Heda, Hepda, Oda or Eda.

Further more preferable other examples of Compound (I) include a peptide represented by the following formula (IX) or a salt thereof. formula (IX):

$P^1$-Tyr-Aib-Glu-Gly-Thr-Iva-Ile-Ser-Asp-Tyr-Ser-Ile-Aib-Leu-Asp-Arg-Lys(R)-A18-Gln-Aib-Asn-Phe-Val-Asn-Trp-Iva-Leu-Ala-Gln-Arg-Pro-Ser-Ser-Gly-Ala-Pro-Pro-Pro-Ser-A40-$P^2$ (SEQ ID NO:569);

In the formula (IX), $P^1$ is defined as above.
$P^2$ is defined as above.
A18 represents Ala or His.
A40 represents Arg or a deletion.
R represents X-L-.
-L- represents -GGGGG- or -GGGGGG-.
X represents Heda, Hepda, Oda or Eda.

Specifically preferable concrete examples of Compound (I) include a peptide represented by the following formula:

```
                                              (SEQ ID NO: 12)
H-Tyr-Aib-Glu-Gly-Thr-Val-Val-Ser-Leu-Tyr-Ser-Ile-

Aib-Leu-Asp-Lys-Gln-Ala-Gln-Aib-Glu-Phe-Val-Lys-

Trp-Leu-Leu-Lys-Gly-Gly-Pro-Ser-Ser-Gly-Ala-Pro-

Pro-Pro-Ser-Lys-NH₂;

(SEQ ID NO: 36)
H-Tyr-Aib-Glu-Gly-Thr-Val-Val-Ser-Leu-Tyr-Ser-Ile-

Aib-Leu-Asp-Arg-Gln-Ala-Gln-Aib-Glu-Phe-Val-Arg-

Trp-Leu-Leu-Arg-Gly-Gly-Pro-Ser-Ser-Gly-Ala-Pro-

Pro-Pro-Ser-Arg-NH₂;
```

(SEQ ID NO: 65)
Me-Tyr-Aib-Glu-Gly-Thr-Phe-Ile-Ser-Asp-Tyr-Ser-
Ile-Ala-Leu-Asp-Arg-Ile-Ala-Gln-Gln-Asp-Phe-Val-
Asn-Trp-Leu-Leu-Ala-Gln-Arg-Pro-Ser-Ser-Gly-Ala-
Pro-Pro-Pro-Ser-Arg-NH$_2$;

(SEQ ID NO: 110)
Me-Tyr-Aib-Glu-Gly-Thr-Iva-Ile-Ser-Asp-Tyr-Ser-
Ile-Ala-Leu-Asp-Arg-Aib-Ala-Gln-Aib-Asn-Phe-Val-
Asn-Trp-Leu-Leu-Ala-Gln-Arg-Pro-Ser-Ser-Gly-Ala-
Pro-Pro-Pro-Ser-Arg-NH$_2$;

(SEQ ID NO: 119)
Me-Tyr-Aib-Glu-Gly-Thr-Iva-Ile-Ser-Asp-Tyr-Ser-
Ile-Aib-Leu-Asp-Arg-Aib-Ala-Gln-Aib-Asn-Phe-Val-
Asn-Trp-Iva-Leu-Ala-Gln-Arg-Pro-Ser-Ser-Gly-Ala-
Pro-Pro-Pro-Ser-Arg-NH$_2$;

(SEQ ID NO: 123)
Me-Tyr-Aib-Glu-Gly-Thr-Phe-Ile-Ser-Asp-Tyr-Ser-
Ile-Ala-Leu-Asp-Arg-Aib-His-Gln-Aib-Asn-Phe-Val-
Asn-Trp-Iva-Leu-Ala-Gln-Arg-Pro-Ser-Ser-Gly-Ala-
Pro-Pro-Pro-Ser-Arg-NH$_2$;

(SEQ ID NO: 458)
Me-Tyr-Aib-Glu-Gly-Thr-Iva-Ile-Ser-Asp-Tyr-Ser-
Ile-Aib-Lys(Heda-GGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 470)
Me-Tyr-Aib-Glu-Gly-Thr-Iva-Ile-Ser-Asp-Tyr-Ser-
Ile-Aib-Lys(Heda-GGGGGG-)-Asp-Arg-Aib-Ala-Gln-
Aib-Asn-Phe-Val-Asn-Trp-Iva-Leu-Ala-Gln-Arg-Pro-
Ser-Ser-Gly-Ala-Pro-Pro-Pro-Ser-NH$_2$;

(SEQ ID NO: 478)
Me-Tyr-Aib-Glu-Gly-Thr-Iva-Ile-Ser-Asp-Tyr-Ser-
Ile-Aib-Lys(Hepda-GGGGG-)-Asp-Arg-Aib-Ala-Gln-
Aib-Asn-Phe-Val-Asn-Trp-Iva-Leu-Ala-Gln-Arg-Pro-
Ser-Ser-Gly-Ala-Pro-Pro-Pro-Ser-NH$_2$;

(SEQ ID NO: 479)
Me-Tyr-Aib-Glu-Gly-Thr-Iva-Ile-Ser-Asp-Tyr-Ser-
Ile-Aib-Lys(Hepda-GGGGGG-)-Asp-Arg-Aib-Ala-Gln-
Aib-Asn-Phe-Val-Asn-Trp-Iva-Leu-Ala-Gln-Arg-Pro-
Ser-Ser-Gly-Ala-Pro-Pro-Pro-Ser-NH$_2$;

(SEQ ID NO: 454)
Me-Tyr-Aib-Glu-Gly-Thr-Iva-Ile-Ser-Asp-Tyr-Ser-
Ile-Aib-Lys(Oda-GGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 452)
Me-Tyr-Aib-Glu-Gly-Thr-Iva-Ile-Ser-Asp-Tyr-Ser-
Ile-Aib-Lys(Oda-GGGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 354)
Me-Tyr-Aib-Glu-Gly-Thr-Iva-Ile-Ser-Asp-Tyr-Ser-
Ile-Aib-Lys(Eda-GGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 355)
Me-Tyr-Aib-Glu-Gly-Thr-Iva-Ile-Ser-Asp-Tyr-Ser-
Ile-Aib-Lys(Eda-GGGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 520)
Me-Tyr-Aib-Glu-Gly-Thr-Iva-Ile-Ser-Asp-Tyr-Ser-
Ile-Aib-Lys(Heda-GGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 522)
Me-Tyr-Aib-Glu-Gly-Thr-Iva-Ile-Ser-Asp-Tyr-Ser-
Ile-Aib-Lys(Heda-GGGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 521)
Me-Tyr-Aib-Glu-Gly-Thr-Iva-Ile-Ser-Asp-Tyr-Ser-
Ile-Aib-Lys(Hepda-GGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 523)
Me-Tyr-Aib-Glu-Gly-Thr-Iva-Ile-Ser-Asp-Tyr-Ser-
Ile-Aib-Lys(Hepda-GGGGGG-)-Asp-Arg-Aib-His-Gln-
Aib-Asn-Phe-Val-Asn-Trp-Iva-Leu-Ala-Gln-Arg-Pro-
Ser-Ser-Gly-Ala-Pro-Pro-Pro-Ser-NH$_2$;

(SEQ ID NO: 495)
Me-Tyr-Aib-Glu-Gly-Thr-Iva-Ile-Ser-Asp-Tyr-Ser-
Ile-Aib-Lys(Oda-GGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 497)
Me-Tyr-Aib-Glu-Gly-Thr-Iva-Ile-Ser-Asp-Tyr-Ser-
Ile-Aib-Lys(Oda-GGGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 488)
Me-Tyr-Aib-Glu-Gly-Thr-Iva-Ile-Ser-Asp-Tyr-Ser-
Ile-Aib-Lys(Eda-GGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH₂;

(SEQ ID NO: 534)
Me-Tyr-Aib-Glu-Gly-Thr-Iva-Ile-Ser-Asp-Tyr-Ser-
Ile-Aib-Lys(Eda-GGGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH₂;

(SEQ ID NO: 536)
Me-Tyr-Aib-Glu-Gly-Thr-Iva-Ile-Ser-Asp-Tyr-Ser-
Ile-Aib-Lys(Heda-GGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 537)
Me-Tyr-Aib-Glu-Gly-Thr-Iva-Ile-Ser-Asp-Tyr-Ser-
Ile-Aib-Lys(Heda-GGGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 538)
Me-Tyr-Aib-Glu-Gly-Thr-Iva-Ile-Ser-Asp-Tyr-Ser-
Ile-Aib-Lys(Hepda-GGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 519)
Me-Tyr-Aib-Glu-Gly-Thr-Iva-Ile-Ser-Asp-Tyr-Ser-
Ile-Aib-Lys(Hepda-GGGGGG-)-Asp-Arg-Aib-Ala-Gln-
Aib-Asn-Phe-Val-Asn-Trp-Iva-Leu-Ala-Gln-Arg-Pro-
Ser-Ser-Gly-Ala-Pro-Pro-Pro-Ser-Arg-NH₂;

(SEQ ID NO: 539)
Me-Tyr-Aib-Glu-Gly-Thr-Iva-Ile-Ser-Asp-Tyr-Ser-
Ile-Aib-Lys(Oda-GGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 492)
Me-Tyr-Aib-Glu-Gly-Thr-Iva-Ile-Ser-Asp-Tyr-Ser-
Ile-Aib-Lys(Oda-GGGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH₂;

(SEQ ID NO: 486)
Me-Tyr-Aib-Glu-Gly-Thr-Iva-Ile-Ser-Asp-Tyr-Ser-
Ile-Aib-Lys(Eda-GGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 533)
Me-Tyr-Aib-Glu-Gly-Thr-Iva-Ile-Ser-Asp-Tyr-Ser-
Ile-Aib-Lys(Eda-GGGGGG-)-Asp-Arg-Aib-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 540)
Me-Tyr-Aib-Glu-Gly-Thr-Iva-Ile-Ser-Asp-Tyr-Ser-
Ile-Aib-Lys(Heda-GGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 541)
Me-Tyr-Aib-Glu-Gly-Thr-Iva-Ile-Ser-Asp-Tyr-Ser-
Ile-Aib-Lys(Heda-GGGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 542)
Me-Tyr-Aib-Glu-Gly-Thr-Iva-Ile-Ser-Asp-Tyr-Ser-
Ile-Aib-Lys(Hepda-GGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 527)
Me-Tyr-Aib-Glu-Gly-Thr-Iva-Ile-Ser-Asp-Tyr-Ser-
Ile-Aib-Lys(Hepda-GGGGGG-)-Asp-Arg-Aib-His-Gln-
Aib-Asn-Phe-Val-Asn-Trp-Iva-Leu-Ala-Gln-Arg-Pro-
Ser-Ser-Gly-Ala-Pro-Pro-Pro-Ser-Arg-NH₂;

(SEQ ID NO: 543)
Me-Tyr-Aib-Glu-Gly-Thr-Iva-Ile-Ser-Asp-Tyr-Ser-
Ile-Aib-Lys(Oda-GGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 495)
Me-Tyr-Aib-Glu-Gly-Thr-Iva-Ile-Ser-Asp-Tyr-Ser-
Ile-Aib-Lys(Oda-GGGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 544)
Me-Tyr-Aib-Glu-Gly-Thr-Iva-Ile-Ser-Asp-Tyr-Ser-
Ile-Aib-Lys(Eda-GGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 535)
Me-Tyr-Aib-Glu-Gly-Thr-Iva-Ile-Ser-Asp-Tyr-Ser-
Ile-Aib-Lys(Eda-GGGGGG-)-Asp-Arg-Aib-His-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH₂;

(SEQ ID NO: 545)
Me-Tyr-Aib-Glu-Gly-Thr-Iva-Ile-Ser-Asp-Tyr-Ser-
Ile-Aib-Leu-Asp-Arg-Lys(Heda-GGGGG-)-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 507)
Me-Tyr-Aib-Glu-Gly-Thr-Iva-Ile-Ser-Asp-Tyr-Ser-
Ile-Aib-Leu-Asp-Arg-Lys(Heda-GGGGGG-)-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 546)
Me-Tyr-Aib-Glu-Gly-Thr-Iva-Ile-Ser-Asp-Tyr-Ser-
Ile-Aib-Leu-Asp-Arg-Lys(Hepda-GGGGG-)-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 508)
Me-Tyr-Aib-Glu-Gly-Thr-Iva-Ile-Ser-Asp-Tyr-Ser-
Ile-Aib-Leu-Asp-Arg-Lys(Hepda-GGGGGG-)-Ala-Gln-
Aib-Asn-Phe-Val-Asn-Trp-Iva-Leu-Ala-Gln-Arg-Pro-
Ser-Ser-Gly-Ala-Pro-Pro-Pro-Ser-NH$_2$;

(SEQ ID NO: 362)
Me-Tyr-Aib-Glu-Gly-Thr-Iva-Ile-Ser-Asp-Tyr-Ser-
Ile-Aib-Leu-Asp-Arg-Lys(Oda-GGGGG-)-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 509)
Me-Tyr-Aib-Glu-Gly-Thr-Iva-Ile-Ser-Asp-Tyr-Ser-
Ile-Aib-Leu-Asp-Arg-Lys(Oda-GGGGGG-)-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 547)
Me-Tyr-Aib-Glu-Gly-Thr-Iva-Ile-Ser-Asp-Tyr-Ser-
Ile-Aib-Leu-Asp-Arg-Lys(Eda-GGGGG-)-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 548)
Me-Tyr-Aib-Glu-Gly-Thr-Iva-Ile-Ser-Asp-Tyr-Ser-
Ile-Aib-Leu-Asp-Arg-Lys(Eda-GGGGGG-)-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 549)
Me-Tyr-Aib-Glu-Gly-Thr-Iva-Ile-Ser-Asp-Tyr-Ser-
Ile-Aib-Leu-Asp-Arg-Lys(Heda-GGGGG-)-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 516)
Me-Tyr-Aib-Glu-Gly-Thr-Iva-Ile-Ser-Asp-Tyr-Ser-
Ile-Aib-Leu-Asp-Arg-Lys(Heda-GGGGGG-)-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 515)
Me-Tyr-Aib-Glu-Gly-Thr-Iva-Ile-Ser-Asp-Tyr-Ser-
Ile-Aib-Leu-Asp-Arg-Lys(Hepda-GGGGG-)-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 517)
Me-Tyr-Aib-Glu-Gly-Thr-Iva-Ile-Ser-Asp-Tyr-Ser-
Ile-Aib-Leu-Asp-Arg-Lys(Hepda-GGGGGG-)-His-Gln-
Aib-Asn-Phe-Val-Asn-Trp-Iva-Leu-Ala-Gln-Arg-Pro-
Ser-Ser-Gly-Ala-Pro-Pro-Pro-Ser-NH$_2$;

(SEQ ID NO: 504)
Me-Tyr-Aib-Glu-Gly-Thr-Iva-Ile-Ser-Asp-Tyr-Ser-
Ile-Aib-Leu-Asp-Arg-Lys(Oda-GGGGG-)-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 505)
Me-Tyr-Aib-Glu-Gly-Thr-Iva-Ile-Ser-Asp-Tyr-Ser-
Ile-Aib-Leu-Asp-Arg-Lys(Oda-GGGGGG-)-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 506)
Me-Tyr-Aib-Glu-Gly-Thr-Iva-Ile-Ser-Asp-Tyr-Ser-
Ile-Aib-Leu-Asp-Arg-Lys(Eda-GGGGG-)-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 550)
Me-Tyr-Aib-Glu-Gly-Thr-Iva-Ile-Ser-Asp-Tyr-Ser-
Ile-Aib-Leu-Asp-Arg-Lys(Eda-GGGGGG-)-His-Gln-Aib-
Asn-Phe-Val-Asn-Trp-Iva-Leu-Ala-Gln-Arg-Pro-Ser-
Ser-Gly-Ala-Pro-Pro-Pro-Ser-NH$_2$;

(SEQ ID NO: 551)
Me-Tyr-Aib-Glu-Gly-Thr-Iva-Ile-Ser-Asp-Tyr-Ser-
Ile-Aib-Leu-Asp-Arg-Lys(Heda-GGGGG-)-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH$_2$;

(SEQ ID NO: 552)
Me-Tyr-Aib-Glu-Gly-Thr-Iva-Ile-Ser-Asp-Tyr-Ser-
Ile-Aib-Leu-Asp-Arg-Lys(Heda-GGGGGG-)-Ala-Gln-Aib-
Asn-Phe-Val-Asn-Trp-Iva-Leu-Ala-Gln-Arg-Pro-Ser-
Ser-Gly-Ala-Pro-Pro-Pro-Ser-Arg-NH$_2$;

(SEQ ID NO: 553)
Me-Tyr-Aib-Glu-Gly-Thr-Iva-Ile-Ser-Asp-Tyr-Ser-Ile-Aib-Leu-Asp-Arg-Lys(Hepda-GGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 554)
Me-Tyr-Aib-Glu-Gly-Thr-Iva-Ile-Ser-Asp-Tyr-Ser-Ile-Aib-Leu-Asp-Arg-Lys(Hepda-GGGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 555)
Me-Tyr-Aib-Glu-Gly-Thr-Iva-Ile-Ser-Asp-Tyr-Ser-Ile-Aib-Leu-Asp-Arg-Lys(Oda-GGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 556)
Me-Tyr-Aib-Glu-Gly-Thr-Iva-Ile-Ser-Asp-Tyr-Ser-Ile-Aib-Leu-Asp-Arg-Lys(Oda-GGGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 557)
Me-Tyr-Aib-Glu-Gly-Thr-Iva-Ile-Ser-Asp-Tyr-Ser-Ile-Aib-Leu-Asp-Arg-Lys(Eda-GGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 558)
Me-Tyr-Aib-Glu-Gly-Thr-Iva-Ile-Ser-Asp-Tyr-Ser-Ile-Aib-Leu-Asp-Arg-Lys(Eda-GGGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 559)
Me-Tyr-Aib-Glu-Gly-Thr-Iva-Ile-Ser-Asp-Tyr-Ser-Ile-Aib-Leu-Asp-Arg-Lys(Heda-GGGGG-)-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 560)
Me-Tyr-Aib-Glu-Gly-Thr-Iva-Ile-Ser-Asp-Tyr-Ser-Ile-Aib-Leu-Asp-Arg-Lys(Heda-GGGGGG-)-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 561)
Me-Tyr-Aib-Glu-Gly-Thr-Iva-Ile-Ser-Asp-Tyr-Ser-Ile-Aib-Leu-Asp-Arg-Lys(Hepda-GGGGG-)-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 562)
Me-Tyr-Aib-Glu-Gly-Thr-Iva-Ile-Ser-Asp-Tyr-Ser-Ile-Aib-Leu-Asp-Arg-Lys(Hepda-GGGGGG-)-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 563)
Me-Tyr-Aib-Glu-Gly-Thr-Iva-Ile-Ser-Asp-Tyr-Ser-Ile-Aib-Leu-Asp-Arg-Lys(Oda-GGGGG-)-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 499)
Me-Tyr-Aib-Glu-Gly-Thr-Iva-Ile-Ser-Asp-Tyr-Ser-Ile-Aib-Leu-Asp-Arg-Lys(Oda-GGGGGG-)-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

(SEQ ID NO: 564)
Me-Tyr-Aib-Glu-Gly-Thr-Iva-Ile-Ser-Asp-Tyr-Ser-Ile-Aib-Leu-Asp-Arg-Lys(Eda-GGGGG-)-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;
or (SEQ ID NO: 565)
Me-Tyr-Aib-Glu-Gly-Thr-Iva-Ile-Ser-Asp-Tyr-Ser-Ile-Aib-Leu-Asp-Arg-Lys(Eda-GGGGGG-)-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$;

or a salt thereof.

Additionally, Specifically preferable other examples of Compound (I) include a peptide represented by the following formula (X) or a salt thereof.

formula (X):

(SEQ ID NO: 566)
P$^1$-Tyr-Aib-Glu-Gly-Thr-Iva-Ile-Ser-Asp-Tyr-Ser-Ile-Aib-A14-Asp-Arg-A17-A18-Gln-Aib-Asn-Phe-Val-Asn-Trp-Iva-Leu-Ala-Gln-Arg-Pro-Ser-Ser-Gly-Ala-Pro-Pro-Pro-Ser-A40-P$^2$

In the formula (X), P$^1$ is defined as above.
P$^2$ is defined as above.
A14 represents Leu.
A17 represents Aib.
A18 represents Ala or His.
A40 represents Arg or a deletion.
Any one of amino acids selected from A14 and A17 represent Lys(R).
R represents X-L-.
L represents a glycine linker comprising five or six-linked glycines.
X represents $C_{16}$-$C_{20}$ linear saturated dicarboxylic acid.
Moreover, examples of Compound (I) include peptides represented by SEQ ID NO: 1, SEQ ID NO: 2, or SEQ ID NO: 3.

Compound (I) can be produced according to a peptide synthesis method known per se. The peptide synthesis method may be any of, for example, a solid phase synthesis process and a liquid phase synthesis process. That is, the object peptide can be produced by repeating condensation of a partial peptide or amino acid capable of constituting compound (I) and the remaining portion (which may be constituted by two or more amino acids) according to a desired sequence. When a product having the desirable sequence has a protecting group, the object peptide can be produced by eliminating a protecting group. Examples of the condensing method and eliminating method of a protecting group to be known include methods described in the following (1)-(5).
(1) M. Bodanszky and M. A. Ondetti: Peptide Synthesis, Interscience Publishers, New York (1966)
(2) Schroeder and Luebke: The Peptide, Academic Press, New York (1965)
(3) Nobuo Izumiya, et al.: Peptide Gosei-no-Kiso to Jikken (Basics and experiments of peptide synthesis), published by Maruzen Co. (1975)
(4) Haruaki Yajima and Shunpei Sakakibara: Seikagaku Jikken Koza (Biochemical Experiment) 1, Tanpakushitsu no Kagaku (Chemistry of Proteins) IV, 205 (1977)
(5) Haruaki Yajima, ed.: Zoku Iyakuhin no Kaihatsu (A sequel to Development of Pharmaceuticals), Vol. 14, Peptide Synthesis, published by Hirokawa Shoten After the reaction, compound (I) can be purified and isolated using conventional methods of purification, such as solvent extraction, distillation, column chromatography, liquid chromatography, recrystallization, etc., in combination thereof. When the peptide obtained by the above-mentioned method is in a free form, it can be converted to a suitable salt by a known method; conversely, when the peptide is obtained in the form of a salt, the salt can be converted to a free form or other salt by a known method.

The starting compound may also be a salt. Examples of such salt include those exemplified as salts of compound (I) mentioned bellow.

For condensation of protected amino acid or peptide, various activation reagents usable for peptide synthesis can be used, which are particularly preferably trisphosphonium salts, tetramethyluronium salts, carbodiimides and the like. Examples of the trisphosphonium salt include benzotriazol-1-yloxytris(pyrrolizino)phosphoniumhexafluorophosphate (PyBOP), bromotris(pyrrolizino)phosphoniumhexafluorophosphate (PyBroP), 7-azabenzotriazol-1-yloxytris(pyrrolizino)phosphoniumhexafluorophosphate (PyAOP), examples of the tetramethyluronium salt include 2-(1H-benzotriazol-1-yl)-1,1,3,3-tetramethyluroniumhexafluorophosphate (HBTU), 2-(7-azabenzotriazol-1-yl)-1,1,3,3-tetramethyluroniumhexafluorophosphate (HATU), 2-(1H-benzotriazol-1-yl)-1,1,3,3-tetramethyluroniumtetrafluoroborate (TBTU), 2-(5-norbornane-2,3-dicarboxyimide)-1,1,3,3-tetramethyluroniumtetrafluoroborate (TNTU), O—(N-succimidyl)-1,1,3,3-tetramethyluroniumtetrafluoroborate (TSTU), and examples of the carbodiimide include N,N'-Dicyclohexylcarbodiimide (DCC), N,N'-diisopropylcarbodiimide (DIPCDI), N-ethyl-N'-(3-dimethylaminopropyl) carbodiimide hydrochloride (EDCI.HCl) and the like. For condensation using these, addition of a racemization inhibitor [e.g., N-hydroxy-5-norbornene-2,3-dicarboxylic imide (HONB), 1-hydroxybenzotriazole (HOBt), 1-Hydroxy-7-azabenzotriazole (HOAt), 3,4-Dihydro-3-hydroxy-4-oxo-1,2,3-benzotriazine (HOOBt), ethyl 2-cyano-2-(hydroxyimino)acetate (Oxyma)etc.] is preferable. A solvent to be used for the condensation can be appropriately selected from those known to be usable for peptide condensation reaction. For example, acid amides such as anhydrous or water-containing N,N-dimethylformamide, N,N-dimethylacetamide, N-methylpyrrolidone and the like, halogenated hydrocarbons such as methylene chloride, chloroform and the like, alcohols such as trifluoroethanol, phenol and the like, sulfoxides such as dimethylsulfoxide and the like, tertiary amines such as pyridine and the like, ethers such as dioxane, tetrahydrofuran and the like, nitriles such as acetonitrile, propionitrile and the like, esters such as methyl acetate, ethyl acetate and the like, an appropriate mixture of these and the like can be used. Reaction temperature is appropriately selected from the range known to be usable for peptide binding reactions, and is normally selected from the range of about −20° C. to 90° C. An activated amino acid derivative is normally used from 1.5 to 6 times in excess. In solid phase synthesis, when a test using the ninhydrin reaction reveals that the condensation is insufficient, sufficient condensation can be conducted by repeating the condensation reaction without elimination of protecting groups. If the condensation is yet insufficient even after repeating the reaction, unreacted amino acids can be acylated with acetic anhydride, acetylimidazole or the like so that an influence on the subsequent reactions can be avoided.

Examples of the protecting groups for the amino groups of the starting amino acid include benzyloxycarbonyl (Z), tert-butoxycarbonyl (Boc), tert-pentyloxycarbonyl, isobornyloxycarbonyl, 4-methoxybenzyloxycarbonyl, 2-chlorobenzyloxycarbonyl (Cl—Z), 2-bromobenzyloxycarbonyl (Br—Z), adamantyloxycarbonyl, trifluoroacetyl, phthaloyl, formyl, 2-nitrophenylsulphenyl, diphenylphosphinothioyl, 9-fluorenylmethyloxycarbonyl (Fmoc), trityl and the like.

Examples of the carboxyl-protecting group for the starting amino acid include aryl, 2-adamantyl, 4-nitrobenzyl, 4-methoxybenzyl, 4-chlorobenzyl, phenacyl and benzyloxycarbonylhydrazide, tert-butoxycarbonylhydrazide, tritylhydrazide and the like, in addition to the above-mentioned $C_{1-6}$ alkyl group, $C_{3-10}$ cycloalkyl group, $C_{7-14}$ aralkyl group.

The hydroxyl group of serine or threonine can be protected, for example, by esterification or etherification. Examples of the group suitable for the esterification include lower ($C_{2-4}$) alkanoyl groups such as an acetyl group and the like, aroyl groups such as a benzoyl group and the like, and the like, and a group derived from an organic acid and the like. In addition, examples of the group suitable for etherification include benzyl, tetrahydropyranyl, tert-butyl(Bu$^t$), trityl (Trt) and the like.

Examples of the protecting group for the phenolic hydroxyl group of tyrosine include Bzl, 2,6-dichlorobenzyl, 2-nitrobenzyl, Br—Z, tert-butyl and the like.

Examples of the protecting group for the imidazole of histidine include p-toluenesulfonyl (Tos), 4-methoxy-2,3,6-trimethylbenzenesulfonyl (Mtr), dinitrophenyl (DNP), benzyloxymethyl (Bom), tert-butoxymethyl (Bum), Boc, Trt, Fmoc and the like.

Examples of the protecting group for the guanidino group of arginine include Tos, Z, 4-methoxy-2,3,6-trimethylbenzenesulfonyl (Mtr), p-methoxybenzenesulfonyl (MBS), 2,2,5,7,8-pentamethylchromane-6-sulfonyl (Pmc), mesitylene-2-sulfonyl (Mts), 2,2,4,6,7-pentamethyldihydrobenzofuran-5-sulfonyl (Pbf), Boc, Z, $NO_2$ and the like.

Examples of the protecting group for a side chain amino group of lysine include Z, Cl—Z, trifluoroacetyl, Boc, Fmoc, Trt, Mtr, 4,4-dimethyl-2,6-dioxocyclohexylideneyl (Dde) and the like.

Examples of the protecting group for indolyl of tryptophan include formyl (For), Z, Boc, Mts, Mtr and the like.

Examples of the protecting group for asparagine and glutamine include Trt, xanthyl (Xan), 4,4'-dimethoxybenzhydryl (Mbh), 2,4,6-trimethoxybenzyl (Tmob) and the like.

Examples of activated carboxyl groups in the starting material include corresponding acid anhydride, azide, active esters [ester with alcohol (e.g., pentachlorophenol, 2,4,5-trichlorophenol, 2,4-dinitrophenol, cyanomethylalcohol, paranitrophenol, HONB, N-hydroxysuccimide, 1-hydroxybenzotriazole (HOBt), 1-hydroxy-7-azabenzotriazole (HOAt))] and the like. Examples of the activated amino group in the starting material include corresponding phosphorous amide.

Examples of the method for removing (eliminating) a protecting group include a catalytic reduction in a hydrogen stream in the presence of a catalyst such as Pd-black or Pd-carbon; an acid treatment using anhydrous hydrogen fluoride, methanesulfonic acid, trifluoromethanesulfonic acid, trifluoroacetic acid (TFA), trimethylsilyl bromide (TMSBr), trimethylsilyl trifluoromethanesulfonate, tetrafluoroboric acid, tris(trifluoro)boric acid, boron tribromide, or a mixture solution thereof; a base treatment using diisopropylethylamine, triethylamine, piperidine, piperazine or the like; and reduction with sodium in liquid ammonia, and the like. The elimination reaction by the above-described acid treatment is generally carried out at a temperature of −20° C. to 40° C.; the acid treatment is efficiently conducted by adding a cation scavenger such as anisole, phenol, thioanisole, metacresol and paracresol; dimethylsulfide, 1,4-butanedithiol, 1,2-ethanedithiol, triisopropylsilane and the like. Also, a 2,4-dinitrophenyl group used as a protecting group of the imidazole of histidine is removed by thiophenol treatment; a formyl group used as a protecting group of the indole of tryptophan is removed by deprotection by acid treatment in the presence of 1,2-ethanedithiol, 1,4-butanedithiol, or the like, as well as by alkali treatment with dilute sodium hydroxide, dilute ammonia, or the like.

Protection of a functional group that should not be involved in the reaction of a starting material and a protecting group, elimination of the protecting group, activation of a functional group involved in the reaction and the like can be appropriately selected from known protecting groups and known means.

In a method of preparing an amide of the peptide, it is formed by a solid phase synthesis using a resin for amide synthesis, or the α-carboxyl group of the carboxy terminal amino acid is amidated, and a peptide chain is elongated to a desired chain length toward the amino group side, thereafter a peptide wherein the protecting group for the N-terminal α-amino group of the peptide chain only removed and a peptide wherein the protecting group for the C-terminal carboxyl group only removed of the peptide chain are prepared, and the both peptides are condensed in a mixed solvent described above. For details about the condensation reaction, the same as above applies. After the protected peptide obtained by the condensation is purified, all protecting groups can be removed by the above-described method to yield a desired crude polypeptide. By purifying this crude peptide using various publicly known means of purification, and freeze-drying the main fraction, a desired amide of the peptide can be prepared.

When the compound (I) is present as a configurational isomer such as enantiomer, diastereomer etc., a conformer or the like, they are also encompassed in compound (I) and each can be isolated by a means known per se or the above separation and purification methods on demand. In addition, when the compound (I) is in the form of a racemate, it can be separated into S- and R-forms by conventional optical resolution.

When the compound (I) includes stereoisomers, both the isomers alone and mixtures of each isomers are also encompassed in compound (I).

Compound (I) can be chemically modified according to a method known per se and using substituent and polyethylene glycol. For example, chemically modified compound (I) can be produced by introducing substituent and/or conjugatedly binding polyethylene glycol to Cys residue, Asp residue, Glu residue, Lys residue and the like of compound (I). Additionaly, there may be a linker structure between the compound (I) and substituent and polyethylene glycol.

Compound (I) modified by substituent and/or polyethylene glycol (PEG) produces, for example, the effects of promoting the biological activity, prolonging the blood circulation time, reducing the immunogenicity, enhancing the solubility, and enhancing the resistance to metabolism, of a therapeutically and diagnostically important peptide.

The molecular weight of PEG is not particularly limited and is normally about 1 K to about 1000 K daltons, preferably about 10 K to about 100 K daltons, more preferably about 20 K to about 60 K daltons.

Modifying compound (I) by substituent can be conducted by introducing the substituent based on known oxidation reaction and reduction reaction.

A method well known in the art can be used as a method for modifying compound (I) by PEG, and, for example, the methods described below can be used.

(1) A PEGylating reagent having an active ester (e.g., SUNBRIGHT MEGC-30TS (trade name), NOF Corp.) is bound to the amino group of compound (I).

(2) A PEGylating reagent having an aldehyde (e.g., SUNBRIGHT ME-300AL (trade name), NOF Corp.) is bound to the amino group of compound (I).

(3) A divalent cross-linking reagent (e.g., GMBS (Dojindo Laboratories), EMCS (Dojindo Laboratories), KMUS (Dojindo Laboratories), SMCC (Pierce)) is bound to compound (I), to which a PEGylating reagent having a thiol group (e.g., SUNBRIGHT ME-300-SH (trade name), NOF Corp.) is then bound.

(4) A thiol group is introduced to compound (I) through an SH-introducing agent (e.g., D-cysteine residue, L-cysteine residue, Traut's reagent), and this thiol group is reacted with a PEGylating reagent having a maleimide group (e.g., SUNBRIGHT ME-300MA (trade name), NOF Corp.).

(5) A thiol group is introduced to compound (I) through an SH-introducing agent (e.g., D-cysteine residue, L-cysteine residue, Traut's reagent), and this thiol group is reacted with a PEGylating reagent having an iodoacetamide group (e.g., SUNBRIGHT ME-300IA (trade name), NOF Corp.).

(6) A ω-aminocarboxylic acid, an α-amino acid or the like is introduced as a linker to the N-terminal amino group of compound (I), and an amino group derived from this linker is reacted with a PEGylating reagent having an active ester (e.g., SUNBRIGHT MEGC-30TS (trade name), NOF Corp.).

(7) A ω-aminocarboxylic acid, an α-amino acid or the like is introduced as a linker to the N-terminal amino group of compound (I), and an amino group derived from this linker is reacted with a PEGylating reagent having an aldehyde group (e.g., SUNBRIGHT ME-300AL (trade name), NOF Corp.).

In addition, the compound (I) may be a solvate (e.g., hydrate) or a non-solvate (e.g., non-hydrate).

The compound (I) may be labeled with an isotope (e.g., $^3H$, $^{14}C$, $^{35}S$, $^{125}I$) or the like.

Furthermore, compound (I) may be a deuterium conversion form wherein $^1H$ is converted to $^2H(D)$.

Compound (I) labeled or substituted with an isotope can be used as, for example, a tracer (PET tracer) for use in Positron Emission Tomography (PET), and is useful in the fields of medical diagnosis and the like.

For the peptides mentioned herein, the left end is the N-terminal (amino terminal) and the right end is the C-terminal (carboxyl terminal) in accordance with the conventional peptide marking. The C-terminal of peptide may be any of an amide (—$CONH_2$), a carboxyl group (—COOH), a carboxylate (—$COO^-$), an alkylamide (—$CONHR^a$), and an ester (—$COOR^a$). Particularly, amide (—$CONH_2$) is preferable.

Compound (I) may be in a salt form. Examples of such salt include metal salts, ammonium salts, salts with organic base, salts with inorganic acid, salts with organic acid, salts with basic or acidic amino acid, and the like.

Preferable examples of the metal salt include alkali metal salts such as sodium salt, potassium salt and the like; alkaline earth metal salts such as calcium salt, magnesium salt, barium salt and the like; aluminum salt and the like.

Preferable examples of the salt with organic base include salts with trimethylamine, triethylamine, pyridine, picoline, 2,6-lutidine, ethanolamine, diethanolamine, triethanolamine, cyclohexylamine, dicyclohexylamine, N,N-dibenzylethylenediamine and the like.

Preferable examples of the salt with inorganic acid include salts with hydrochloric acid, hydrobromic acid, nitric acid, sulfuric acid, phosphoric acid and the like.

Preferable examples of the salt with organic acid include salts with formic acid, acetic acid, trifluoroacetic acid, phthalic acid, fumaric acid, oxalic acid, tartaric acid, maleic acid, citric acid, succinic acid, malic acid, methanesulfonic acid, benzenesulfonic acid, p-toluenesulfonic acid and the like.

Preferable examples of the salt with basic amino acid include salts with arginine, lysine, ornithine and the like. Preferable examples of the salt with acidic amino acid include salts with aspartic acid, glutamic acid and the like.

Among the above-mentioned salts, a pharmaceutically acceptable salt is preferable. For example, when a compound has an acidic functional group, an inorganic salt such as alkali metal salt (e.g., sodium salt, potassium salt etc.), alkaline earth metal salt (e.g., calcium salt, magnesium salt, barium salt etc.) and the like, ammonium salt etc., and when a compound has a basic functional group, for example, a salt with inorganic acid such as hydrochloric acid, hydrobromic acid, nitric acid, sulfuric acid, phosphoric acid and the like, or a salt with organic acid such as acetic acid, phthalic acid, fumaric acid, oxalic acid, tartaric acid, maleic acid, citric acid, succinic acid, methanesulfonic acid, p-toluenesulfonic acid and the like are preferable.

Compound (I) may be in a prodrug form. A prodrug means a compound which is converted to compound (I) with a reaction due to an enzyme, gastric acid, etc. under the physiological condition in the living body, that is, a compound which is converted to compound (I) with oxidation, reduction, hydrolysis, etc. according to an enzyme; a compound which is converted to compound (I) by hydrolysis etc. due to gastric acid, etc.

Examples of a prodrug of compound (I) include a compound wherein an amino of compound (I) is acylated, alkylated or phosphorylated (e.g., compound wherein amino of compound (I) is eicosanoylated, alanylated, pentylaminocarbonylated, (5-methyl-2-oxo-1,3-dioxolen-4-yl) methoxycarbonylated, tetrahydrofuranylated, pyrrolidylmethylated, pivaloyloxymethylated or tert-butylated, and the like); a compound wherein a hydroxy of compound (I) is acylated, alkylated, phosphorylated or borated (e.g., a compound wherein a hydroxy of compound (I) is acetylated, palmitoylated, propanoylated, pivaloylated, succinylated, fumarylated, alanylated or dimethylaminomethylcarbonylated); a compound wherein a carboxy of compound (I) is esterified or amidated (e.g., a compound wherein a carboxy of compound (I) is $C_{1-6}$ alkyl esterified, phenyl esterified, carboxymethyl esterified, dimethylaminomethyl esterified, pivaloyloxymethyl esterified, ethoxycarbonyloxyethyl esterified, phthalidyl esterified, (5-methyl-2-oxo-1,3-dioxolen-4-yl)methyl esterified, cyclohexyloxycarbonylethyl esterified or methylamidated) and the like. Among others, a compound wherein carboxy of compound (I) is esterified with $C_{1-6}$ alkyl such as methyl, ethyl, tert-butyl or the like is preferably used. These compounds can be produced from compound (I) by a method known per se.

A prodrug of compound (I) may also be one which is converted into compound (I) under a physiological condition, such as those described in IYAKUHIN no KAIHATSU (Development of Pharmaceuticals), Vol. 7, Design of Molecules, p. 163-198, Published by HIROKAWA SHOTEN (1990).

In the present specification, the prodrug may form a salt. Examples of such a salt include those exemplified as the salt of compound (I).

Compound (I) may be a crystal. Crystals having a singular crystal form or a mixture of plural crystal forms are also included in compound (I). Crystals can be produced by crystallizing compound (I) according to a crystallization method known per se.

In addition, compound (I) may be a pharmaceutically acceptable cocrystal or cocrystal salt. Here, the cocrystal or cocrystal salt means a crystalline substance consisting of two or more particular substances which are solids at room temperature, each having different physical properties (e.g., structure, melting point, heat of melting, hygroscopicity, solubility, stability etc.). The cocrystal and cocrystal salt can be produced by cocrystallization known per se.

The crystal of compound (I) is superior in physicochemical properties (e.g., melting point, solubility, stability) and biological properties (e.g., pharmacokinetics (absorption, distribution, metabolism, excretion), efficacy expression), and thus it is extremely useful as a medicament.

Compound (I) and a prodrug thereof (hereinafter to be sometimes abbreviated as the compound of the present invention) have a GIP receptor activating action.

The compounds of the present invention have a high GIP receptor selective activation action in vivo.

GIP is a gastrointestinal hormone called incretin and has a promoting action on insulin secretion from the pancreas. Incretin is closely related to glucose metabolism and thus the compound having a GIP receptor activation action is useful for preventing and treating symptoms related to abnormal glucose metabolism including diabetes and obesity. Additionally, the compounds of the present invention have a GIP receptor selective activation action and suppress vomiting by activating GABAergic neurons in the area postrema.

More specifically, the compounds of the present invention have a hypoglycemic action, an antiemetic action, and the like.

The compounds of the present invention have a high chemical stability and excellent persistence of the effects in vivo.

The compounds of the present invention may be used as a GIP receptor activator.

In the present invention, the GIP receptor activator (GIP receptor agonist) means an agent having a GIP receptor activation action. Additionally, the GIP receptor selective activator (GIP receptor selective agonist) specifically means an agent having an EC50 for the GIP receptor of 1/1000 or less, and preferably 1/10000 or less, times the EC50 for the GLP-1 receptor.

The compound of the present invention is low in its toxicity (e.g., acute toxicity, chronic toxicity, genetic toxicity, reproductive toxicity, cardiac toxicity, carcinogenicity), shows a few side effects, and can be safely administered to a mammal (e.g., human, bovine, horse, dog, cat, monkey, mouse, rat) as an agent for the prophylaxis or treatment of various diseases mentioned below and the like.

The compound of the present invention can be used as an agent for the treatment or prophylaxis of various diseases including diabetes and obesity, by virtue of the above-mentioned activating action on GIP receptors. The compound of the present invention can be used as an agent for the prophylaxis or treatment of, for example, symptomatic obesity, obesity based on simple obesity, disease state or disease associated with obesity, eating disorder, diabetes (e.g., type 1 diabetes, type 2 diabetes, gestational diabetes, obese diabetes), hyperlipidemia (e.g., hypertriglyceridemia, hypercholesterolemia, high LDL-cholesterolemia, low HDL-cholesterolemia, postprandial hyperlipemia), hypertension, cardiac failure, diabetic complications [e.g., neuropathy, nephropathy, retinopathy, diabetic cardiomyopathy, cataract, macroangiopathy, osteopenia, hyperosmolar diabetic coma, infectious disease (e.g., respiratory infection, urinary tract infection, gastrointestinal infection, dermal soft tissue infections, inferior limb infection), diabetic gangrene, xerostomia, hypacusis, cerebrovascular disorder, peripheral blood circulation disorder], metabolic syndrome (disease states having 3 or more selected from hypertriglycerid(TG)emia, low HDL cholesterol(HDL-C)emia, hypertension, abdominal obesity and impaired glucose tolerance), sarcopenia and the like.

Examples of the symptomatic obesity include endocrine obesity (e.g., Cushing syndrome, hypothyroidism, insulinoma, obese type II diabetes, pseudohypoparathyroidism, hypogonadism), central obesity (e.g., hypothalamic obesity, frontal lobe syndrome, Kleine-Levin syndrome), hereditary obesity (e.g., Prader-Willi syndrome, Laurence-Moon-Biedl syndrome), drug-induced obesity (e.g., steroid, phenothiazine, insulin, sulfonylurea (SU) agent, β-blocker-induced obesity) and the like.

Examples of the disease state or disease associated with obesity include glucose tolerance disorders, diabetes (particularly type 2 diabetes, obese diabetes), lipid metabolism abnormality (synonymous with the above-mentioned hyperlipidemia), hypertension, cardiac failure, hyperuricemia.gout, fatty liver (including non-alchoholic steato-hepatitis), coronary heart disease (myocardial infarction, angina pectoris), cerebral infarction (brain thrombosis, transient cerebral ischemic attack), bone/articular disease (knee osteoarthritis, hip osteoarthritis, spondylitis deformans, lumbago), sleep apnea syndrome/Pickwick syndrome, menstrual disorder (abnormal menstrual cycle, abnormality of menstrual flow and cycle, amenorrhea, abnormal catamenial symptom), metabolic syndrome and the like.

New diagnostic criteria were reported by The Japan Diabetes Society in 1999 about the diagnostic criteria of diabetes.

According to this report, diabetes refers to a state that meets any of a fasting blood glucose level (glucose concentration in venous plasma) of 126 mg/dl or more, a 2-hr value (glucose concentration in venous plasma) of 200 mg/dl or more in the 75 g oral glucose tolerance test (75 g OGTT), and a casual blood glucose level (glucose concentration in venous plasma) of 200 mg/dl or more. Also, a state that does not apply to the above-mentioned diabetes, and is not a state exhibiting "a fasting blood glucose level (glucose concentration in venous plasma) less than 110 mg/dl or a 2-hr value (glucose concentration in venous plasma) less than 140 mg/dl in the 75 g oral glucose tolerance test (75 g OGTT)" (normal type) is called "borderline type".

Moreover, new diagnostic criteria were reported by American Diabetes Association (ADA) in 1997 and by World Health Organization (WHO) in 1998 about the diagnostic criteria of diabetes.

According to these reports, diabetes refers to a state that meets a fasting blood glucose level (glucose concentration in venous plasma) of 126 mg/dl or more and a 2-hr value (glucose concentration in venous plasma) of 200 mg/dl or more in the 75 g oral glucose tolerance test.

According to the above-mentioned reports, impaired glucose tolerance refers to a state that meets a fasting blood glucose level (glucose concentration in venous plasma) less than 126 mg/dl and a 2-hr value (glucose concentration in venous plasma) of 140 mg/dl or more and less than 200 mg/dl in the 75 g oral glucose tolerance test. According to the report of ADA, a state exhibiting a fasting blood glucose level (glucose concentration in venous plasma) of 110 mg/dl or more and less than 126 mg/dl is called IFG (Impaired Fasting Glucose). On the other hand, according to the report of WHO, a state of the IFG (Impaired Fasting Glucose) exhibiting a 2-hr value (glucose concentration in venous plasma) less than 140 mg/dl in the 75 g oral glucose tolerance test is called IFG (Impaired Fasting Glycemia).

The compound of the present invention is also used as an agent for the prophylaxis or treatment of diabetes determined according to the above-mentioned new diagnostic criteria, borderline type diabetes, impaired glucose tolerance, IFG (Impaired Fasting Glucose) and IFG (Impaired Fasting Glycemia). Moreover, the compound of the present invention can prevent progress of borderline type, impaired glucose tolerance, IFG (Impaired Fasting Glucose) or IFG (Impaired Fasting Glycemia) into diabetes.

The compound of the present invention is also useful as an agent for the prophylaxis or treatment of metabolic syndrome. The incidence of cardiovascular disease is significantly high in metabolic syndrome patients, compared with patients with a single lifestyle-related disease. Thus, the prophylaxis or treatment of metabolic syndrome is exceedingly important for preventing cardiovascular disease.

The diagnostic criteria of metabolic syndrome were announced by WHO in 1999 and by NCEP in 2001. According to the diagnostic criteria of WHO, an individual having hyperinsulinemia or abnormal glucose tolerance as a requirement and two or more of visceral obesity, dyslipidemia (high TG or low HDL) and hypertension is diagnosed as having metabolic syndrome (World Health Organization: Definition, Diagnosis and Classification of Diabetes Mellitus and Its Complications. Part I: Diagnosis and Classification of Diabetes Mellitus, World Health Organization, Geneva, 1999). According to the diagnostic criteria of the Adult Treatment Panel III of the National Cholesterol Education Program (guideline of ischemic heart disease) in USA, an individual having three or more of visceral obesity, hypertriglyceridemia, low HDL-cholesterolemia, hypertension and abnormal glucose tolerance is diagnosed as having metabolic syndrome (National Cholesterol Education Program: Executive Summary of the Third Report of National Cholesterol Education Program (NCEP) Expert Panel on Detection, Evaluation, and Treatment of High Blood Cholesterol in Adults (Adults Treatment Panel III). The Journal of the American Medical Association, Vol. 285, 2486-2497, 2001).

The compounds of the present invention may be used as a preventive/therapeutic agent for vomiting or nausea caused, for example, by clinical pathological conditions or causes described in the following (1) to (6). Additionally, the compound of the present invention may be used as a preventive/therapeutic agent for chronic unexplained nausea and vomiting. The vomiting or nausea also includes imminent unpleasant sensations of wanting to eject the contents of the stomach through the mouth such as feeling queasy and retching, and may also be accompanied by autonomic symptoms such as facial pallor, cold sweat, salivary secretion, tachycardia, and diarrhea. The vomiting also includes acute vomiting, protracted vomiting, and anticipatory vomiting.

(1) Diseases accompanied by vomiting or nausea such as gastroparesis, gastrointestinal hypomotility, peritonitis, abdominal tumor, constipation, gastrointestinal obstruction, cyclic vomiting syndrome, chronic unexplained nausea and vomiting, acute pancreatitis, chronic pancreatitis, hyperkalemia, cerebral edema, intracranial lesion, metabolic disorder, gastritis caused by an infection, postoperative disease, myocardial infarction, migraine, intracranial hypertension, and intracranial hypotension (e.g., altitude sickness);

(2) vomiting or nausea induced by drugs such as (i) alkylating agents (e.g., cyclophosphamide, carmustine, lomustine, chlorambucil, streptozocin, dacarbazine, ifosfamide, temozolomide, busulfan, bendamustine, and melphalan), cytotoxic antibiotics (e.g., dactinomycin, doxorubicin, mitomycin-C, bleomycin, epirubicin, actinomycin D, amrubicin, idarubicin, daunorubicin, and pirarubicin), antimetabolic agents (e.g., cytarabine, methotrexate, 5-fluorouracil, enocitabine, and clofarabine), vinca alkaloids (e.g., etoposide, vinblastine, and vincristine), other chemotherapeutic agents such as cisplatin, procarbazine, hydroxyurea, azacytidine, irinotecan, interferon a, interleukin-2, oxaliplatin, carboplatin, nedaplatin, and miriplatin; (ii) opioid analgesics (e.g., morphine); (iii) dopamine receptor D1D2 agonists (e.g., apomorphine); (iv) cannabis and cannabinoid products including cannabis hyperemesis syndrome (3) vomiting or nausea caused by radiation sickness or radiation therapy for the chest, the abdomen, or the like used to treat cancers;

(4) vomiting or nausea caused by a poisonous substance or a toxin;

(5) vomiting and nausea caused by pregnancy including hyperemesis gravidarium; and (6) vomiting and nausea caused by a vestibular disorder such as motion sickness or dizziness.

The compound of the present invention can also be used for secondary prevention or suppression of progression of the above-mentioned various diseases (e.g., cardiovascular events such as myocardial infarction and the like). In addition, the compound of the present invention is also useful as a feeding suppressant and a weight reducing agent. The compound of the present invention can also be used in combination with a diet therapy (e.g., diet therapy for diabetes), and an exercise therapy.

A medicament containing the compound of the present invention shows low toxicity and is obtained using the compound of the present invention alone or in admixture with a pharmacologically acceptable carrier according to a method known per se (e.g., the method described in the Japanese Pharmacopoeia) generally used as production methods of pharmaceutical preparations, and safely administered orally or parenterally (e.g., topically, rectally, intravenously administered) as a pharmaceutical preparation, for example, tablets (inclusive of sugar-coated tablets, film-coated tablets, sublingual tablets, orally disintegrating tablets), powders, granules, capsules (inclusive of soft capsules, microcapsules), liquids, troches, syrups, emulsions, suspensions, injections (e.g., subcutaneous injections, intravenous injections, intramuscular injections, intraperitoneal injections etc.), external preparations (e.g., transnasal preparations, dermal preparations, ointments), suppository (e.g., rectal suppositories, vaginal suppositories), pellets, nasal preparations, pulmonary preparations (inhalants), transfusions and the like.

These preparations may be controlled release preparations such as a rapid release preparation, a sustained release preparation and the like (e.g., a sustained release microcapsule).

The content of the compound of the present invention in a pharmaceutical preparation is about 0.01- about 100 wt % of the whole preparation.

The above-mentioned pharmaceutically acceptable carrier may be exemplified by various organic or inorganic carrier materials that are conventionally used as preparation materials, for example, excipient, lubricant, binding agent and disintegrant for solid preparations; or solvent, solubilizing agent, suspending agent, isotonic agent, buffering agent, soothing agent and the like for liquid preparations. Further, if necessary, general additives such as preservative, antioxidant, colorant, sweetening agent, adsorbing agent, wetting agent and the like can be also used appropriately in a suitable amount.

Examples of the excipient include lactose, sucrose, D-mannitol, starch, corn starch, crystalline cellulose, light anhydrous silicic acid and the like.

Examples of the lubricant include magnesium stearate, calcium stearate, talc, colloidal silica and the like.

Examples of the binding agent include crystalline cellulose, sucrose, D-mannitol, dextrin, hydroxypropylcellulose, hydroxypropylmethylcellulose, polyvinylpyrrolidone, starch, sucrose, gelatin, methylcellulose, carboxymethylcellulose sodium and the like.

Examples of the disintegrant include starch, carboxymethylcellulose, carboxymethylcellulose calcium, carboxymethylstarch sodium, L-hydroxypropylcellulose and the like.

Examples of the solvent include water for injection, alcohol, propylene glycol, Macrogol, sesame oil, corn oil, olive oil and the like.

Examples of the solubilizing agent include polyethylene glycol, propylene glycol, D-mannitol, benzyl benzoate, ethanol, trisaminomethane, cholesterol, triethanolamine, sodium carbonate, sodium citrate and the like.

Examples of the suspending agent include surfactants such as stearyl triethanolamine, sodium lauryl sulfate, laurylaminopropionic acid, lecithin, benzalkonium chloride, benzetonium chloride, glycerin monostearate and the like; hydrophilic polymers such as polyvinyl alcohol, polyvinylpyrrolidone, carboxymethylcellulose sodium, methylcellulose, hydroxymethylcellulose, hydroxyethylcellulose, hydroxypropylcellulose and the like; and the like.

Examples of the isotonic agent include glucose, D-sorbitol, sodium chloride, glycerin, D-mannitol and the like.

Examples of the buffering agent include buffer solutions such as phosphates, acetates, carbonates, citrates and the like.

Examples of the soothing agent include benzyl alcohol and the like.

Examples of the preservative include parahydroxybenzoic acid esters, chlorobutanol, benzyl alcohol, phenethyl alcohol, dehydroacetic acid, sorbic acid and the like.

Examples of the antioxidant include sulfites, ascorbic acid, α-tocopherol and the like.

Examples of the colorant include water-soluble Food coal tar dyes (e.g., Food dyes such as Food Red No. 2 and No. 3, Food Yellow No. 4 and No. 5, Food Blue No. 1 and No. 2, and the like), water-insoluble lake dyes (e.g., aluminum salts of the aforementioned water-soluble Food coal tar dyes), natural dyes (e.g., β-carotene, chlorophyll, ferric oxide red) and the like.

Examples of the sweetening agent include saccharin sodium, dipotassium glycyrrhizinate, aspartame, stevia and the like.

Examples of the adsorbing include porous starch, calcium silicate (trade name: Florite RE), magnesium alumino metasilicate (trade name: Neusilin) and light anhydrous silicic acid (trade name: Sylysia).

Examples of the wetting agent include propylene glycol monostearate, sorbitan monooleate, diethylene glycol monolaurate and polyoxyethylenelauryl ether.

During production of an oral preparation, coating may be applied as necessary for the purpose of masking of taste, enteric property or durability.

Examples of the coating base to be used for coating include sugar coating base, aqueous film coating base, enteric film coating base and sustained-release film coating base.

As the sugar coating base, sucrose is used. Moreover, one or more kinds selected from talc, precipitated calcium carbonate, gelatin, gum arabic, pullulan, carnauba wax and the like may be used in combination.

Examples of the aqueous film coating base include cellulose polymers such as hydroxypropyl cellulose, hydroxypropylmethyl cellulose, hydroxyethyl cellulose, methylhydroxyethyl cellulose etc.; synthetic polymers such as polyvinylacetal diethylaminoacetate, aminoalkyl methacrylate copolymer E [Eudragit E (trade name)], polyvinylpyrrolidone etc.; and polysaccharides such as pullulan etc.

Examples of the enteric film coating base include cellulose polymers such as hydroxypropylmethyl cellulose phthalate, hydroxypropylmethyl cellulose acetate succinate, carboxymethylethyl cellulose, cellulose acetate phthalate etc.; acrylic polymers such as methacrylic acid copolymer L [Eudragit L (trade name)], methacrylic acid copolymer LD [Eudragit L-30D55 (trade name)], methacrylic acid copolymer S [Eudragit S (trade name)] etc.; and naturally occurring substances such as shellac etc.

Examples of the sustained-release film coating base include cellulose polymers such as ethyl cellulose etc.; and acrylic polymers such as aminoalkyl methacrylate copolymer RS [Eudragit RS (trade name)], ethyl acrylate-methyl methacrylate copolymer suspension [Eudragit NE (trade name)] etc.

The above-mentioned coating bases may be used after mixing with two or more kinds thereof at appropriate ratios.

For coating, for example, a light shielding agent such as titanium oxide, red ferric oxide and the like can be used.

The dosage of the compound of the present invention is appropriately determined according to the subject of administration, symptom, administration method and the like. For example, when the compound of the present invention is administered orally to an obesity or diabetes patient or a gastroparesis (body weight 60 kg), the daily dose of the compound of the present invention is about 0.1 to 100 mg, preferably about 1.0 to 50 mg, more preferably about 1.0 to 20 mg. When the compound of the present invention is administered parenterally to an obesity or diabetes patient or a gastroparesis (body weight 60 kg), the daily dose of the compound of the present invention is about 0.001 to 30 mg, preferably about 0.01 to 20 mg, more preferably about 0.1 to 10 mg. These amounts can be administered in about 1 to several portions a day.

The compound of the present invention can be administered, for example, every 2 days, every 3 days, every 4 days, every 5 days, every 6 days, every week, twice per week, every other week, every 3 weeks, every month, every 2 months, every 3 months, every 4 months, every 5 months or every 6 months.

The compound of the present invention can be used in combination with other drug that does not adversely influence the compound of the present invention, for the purpose of, for example, promoting the action (treatment of effect for obesity, diabetes, diseases accompanied by vomiting or nausea, and the like and antiemetic action) of the compound of the present invention, reducing the dose of the compound of the present invention, and the like.

Examples of a drug that can be used in combination with the compound of the present invention (hereinafter sometimes to be abbreviated as a concomitant drug) include anti-obesity agents, therapeutic agents for diabetes, therapeutic agents for diabetic complications, therapeutic agents for hyperlipidemia, antihypertensive agents, diuretics, chemotherapeutics, immunotherapeutics, anti-inflammatory drugs, antithrombotic agents, therapeutic agents for osteoporosis, vitamins, antidementia drugs, erectile dysfunction drugs, therapeutic drugs for urinary frequency or urinary incontinence, therapeutic agents for dysuria, central $D_2$ receptor antagonists, prokinetic agents, antihistamines, muscarine receptor antagonists, serotonin $5HT_3$ receptor antagonists, somatostatin analogues, corticosteroids, benzodiazepine anxiolytics, NK-1 receptor antagonists, hypercalcemia therapeutic drug and the like. Specific examples of the concomitant drug include those mentioned below.

Examples of the anti-obesity agent include monoamine uptake inhibitors (e.g., phentermine, sibutramine, mazindol, fluoxetine, tesofensine), serotonin 2C receptor agonists (e.g., lorcaserin), serotonin 6 receptor antagonists, histamine H3 receptor modulator, GABA modulator (e.g., topiramate), neuropeptide Y antagonists (e.g., velneperit), cannabinoid receptor antagonists (e.g., rimonabant, taranabant), ghrelin antagonists, ghrelin receptor antagonists, ghrelinacylation enzyme inhibitors, opioid receptor antagonists (e.g., GSK-1521498), orexin receptor antagonists, melanocortin 4 receptor agonists, 11β-hydroxysteroid dehydrogenase inhibitors (e.g., AZD-4017), pancreatic lipase inhibitors (e.g., orlistat, cetilistat), β3 agonists (e.g., N-5984), diacylglycerol acyltransferase 1 (DGAT1) inhibitors, acetylCoA carboxylase (ACC) inhibitors, stearoyl-CoA desaturated enzyme inhibitors, microsomal triglyceride transfer protein inhibitors (e.g., R-256918), Na-glucose cotransporter inhibitors (e.g., JNJ-28431754, remogliflozin), NFK inhibitory (e.g., HE-3286), PPAR agonists (e.g., GFT-505, DRF- 11605), phosphotyrosine phosphatase inhibitors (e.g., sodium vanadate, Trodusquemin), GPR119 agonists (e.g., PSN-821, MBX-2982, APD597), glucokinase activators (e.g., AZD-1656), leptin, leptin derivatives (e.g., metreleptin), CNTF (ciliary neurotrophic factor), BDNF (brain-derived neurotrophic factor), cholecystokinin agonists, amylin preparations (e.g., pramlintide, AC-2307), neuropeptide Y agonists (e.g., PYY3-36, derivatives of PYY3-36, obineptide, TM-30339, TM-30335), oxyntomodulin preparations: FGF21 preparations (e.g., animal FGF21 preparations extracted from the pancreas of bovine or swine; human FGF21 preparations genetically synthesized using Escherichia coli or yeast; fragments or derivatives of FGF21), anorexigenic agents (e.g., P-57), GLP-1 receptor agonist, GLP-1 receptor/GIP receptor coagonist, glucagon receptor/GLP-1 receptor/GIP receptor triagonist, and the like.

Here, as the therapeutic agent for diabetes, for example, insulin preparations (e.g., animal insulin preparations extracted from the pancreas of bovine or swine; human insulin preparations genetically synthesized using *Escherichia coli* or yeast; zinc insulin; protamine zinc insulin; fragment or derivative of insulin (e.g., INS-1), oral insulin preparation), insulin sensitizers (e.g., pioglitazone or a salt thereof (preferably, hydrochloride), rosiglitazone or a salt thereof (preferably, maleate), Metaglidasen, AMG-131, Balaglitazone, MBX-2044, Rivoglitazone, Aleglitazar, Chiglitazar, Lobeglitazone, PLX-204, PN-2034, GFT-505, THR-0921, compound described in WO007/013694, WO2007/018314, WO2008/093639 or WO2008/099794), α-glucosidase inhibitors (e.g., voglibose, acarbose, miglitol, emiglitate), biguanides (e.g., metformin, buformin or a salt thereof (e.g., hydrochloride, fumarate, succinate)), insulin secretagogues (e.g., sulfonylurea (e.g., tolbutamide, glibenclamide, gliclazide, chlorpropamide, tolazamide, acetohexamide, glyclopyramide, glimepiride, glipizide, glybuzole), repaglinide, nateglinide, mitiglinide or calcium salt hydrate thereof), dipeptidyl peptidase IV inhibitors (e.g., Alogliptin or a salt thereof (preferably, benzoate), Vildagliptin, Sitagliptin, Saxagliptin, BI1356, GRC8200, MP-513, PF-00734200, PHX1149, SK-0403, ALS2-0426, TA-6666, TS-021, KRP-104, Trelagliptin or a salt thereof (preferably succinate)), β3 agonists (e.g., N-5984), GPR40 agonists (e.g., Fasiglifam or a hydrate thereof, compound described in WO2004/041266, WO2004/106276, WO2005/063729, WO2005/063725, WO2005/087710, WO2005/095338, WO2007/013689 or WO2008/001931), SGLT2 (sodium-glucose cotransporter 2) inhibitors (e.g., Dapagliflozin, AVE2268, TS-033, YM543, TA-7284, Remogliflozin, ASP1941), SGLT1 inhibitors, 11β-hydroxysteroid dehydrogenase inhibitors (e.g., BVT-3498, INCB-13739), adiponectin or agonist thereof, IKK inhibitors (e.g., AS-2868), leptin resistance improving drugs, somatostatin receptor agonists, glucokinase activators (e.g., Piragliatin, AZD1656, AZD6370, TTP-355, compound described in WO006/112549, WO007/028135, WO008/047821, WO008/050821, WO008/136428 or WO008/156757), GPR119 agonists (e.g., PSN821, MBX-2982, APD597), FGF21, FGF analogue, ACC2 inhibitors, GLP-1 receptor agonist, GLP-1 receptor/GIP receptor coagonist, glucagon receptor/GLP-1 receptor/GIP receptor triagonist, and the like can be mentioned.

As the therapeutic agent for diabetic complications, aldose reductase inhibitors (e.g., tolrestat, epalrestat, zopolrestat, fidarestat, CT-112, ranirestat (AS-3201), lidorestat), neurotrophic factor and increasing agents thereof (e.g., NGF, NT-3, BDNF, neurotrophic production/secretion promoting agent described in WO01/14372 (e.g., 4-(4-chlorophenyl)-2-(2-methyl-1-imidazolyl)-5-[3-(2-methylphenoxy)propyl] oxazole), compound described in WO2004/039365), PKC inhibitors (e.g., ruboxistaurin mesylate), AGE inhibitors (e.g., ALT946, N-phenacylthiazolium bromide (ALT766), EXO-226, Pyridorin, pyridoxamine), GABA receptor agonists (e.g., gabapentin, pregabalin), serotonin and noradrenalin reuptake inhibitors (e.g., duloxetine), sodium channel inhibitors (e.g., lacosamide), active oxygen scavengers (e.g., thioctic acid), cerebral vasodilators (e.g., tiapuride, mexiletine), somatostatin receptor agonists (e.g., BIM23190), apoptosis signal regulating kinase-1 (ASK-1) inhibitors, GLP-1 receptor agonist, GLP-1 receptor/GIP receptor coagonist, glucagon receptor/GLP-1 receptor/GIP receptor triagonist, and the like can be mentioned.

As the therapeutic agent for hyperlipidemia, HMG-CoA reductase inhibitors (e.g., pravastatin, simvastatin, lovastatin, atorvastatin, fluvastatin, rosuvastatin, pitavastatin or a salt thereof (e.g., sodium salt, calcium salt)), squalene synthase inhibitors (e.g., compound described in WO97/10224, for example, N-[[(3R,5S)-1-(3-acetoxy-2,2-dimethylpropyl)-7-chloro-5-(2,3-dimethoxyphenyl)-2-oxo-1,2,3,5-tetrahydro-4,1-benzoxazepin-3-yl]acetyl]piperidin-4-acetic acid), fibrate compounds (e.g., bezafibrate, clofibrate, simfibrate, clinofibrate), anion exchange resin (e.g., colestyramine), probucol, nicotinic acid drugs (e.g., nicomol, niceritrol, niaspan), ethyl icosapentate, phytosterol (e.g., soysterol, gamma oryzanol (γ-oryzanol)), cholesterol absorption inhibitors (e.g., zechia), CETP inhibitors (e.g., dalcetrapib, anacetrapib), ω-3 fatty acid preparations (e.g., ω-3-fatty acid ethyl esters 90 (ω-3-acid ethyl esters 90)) and the like can be mentioned.

Examples of the antihypertensive agent include angiotensin converting enzyme inhibitors (e.g., captopril, enalapril, delapril, etc.), angiotensin II antagonists (e.g., candesartan cilexetil, candesartan, losartan, losartan potassium, eprosartan, valsartan, telmisartan, irbesartan, tasosartan, olmesartan, olmesartan medoxomil, azilsartan, azilsartan medoxomil, etc.), calcium antagonists (e.g., manidipine, nifedipine, amlodipine, efonidipine, nicardipine, cilnidipine, etc.), β blockers (e.g., metoprolol, atenolol, propranolol, carvedilol, pindolol, etc.), clonidine and the like.

As the diuretic, for example, xanthine derivatives (e.g., theobromine sodium salicylate, theobromine calcium salicylate and the like), thiazide preparations (e.g., ethiazide, cyclopenthiazide, trichloromethiazide, hydrochlorothiazide, hydroflumethiazide, benzylhydrochlorothiazide, penfluthiazide, poly5thiazide, methyclothiazide and the like), antialdosterone preparations (e.g., spironolactone, triamterene and the like), carbonic anhydrase inhibitors (e.g., acetazolamide and the like), chlorobenzenesulfonamide agents (e.g., chlortalidone, mefruside, indapamide and the like), azosemide, isosorbide, ethacrynic acid, piretanide, bumetanide, furosemide and the like can be mentioned.

Examples of the chemotherapeutic include alkylating agents (e.g., cyclophosphamide, ifosfamide), antimetabolites (e.g., methotrexate, 5-fluorouracil), anticancer antibiotics (e.g., mitomycin, adriamycin), plant-derived anticancer agents (e.g., vincristine, vindesine, Taxol), cisplatin, carboplatin, etoposide and the like. Among others, a 5-fluorouracil derivative Furtulon or Neofurtulon or the like is preferable.

Examples of the immunotherapeutic include microbial or bacterial components (e.g., muramyl dipeptide derivative, Picibanil), polysaccharides having immunoenhancing activity (e.g., lentinan, sizofiran, Krestin), cytokines obtained by genetic engineering approaches (e.g., interferon, interleukin (IL)), colony-stimulating factors (e.g., granulocyte colony-stimulating factor, erythropoietin) and the like. Among others, interleukins such as IL-1, IL-2, IL-12 and the like are preferable.

Examples of the anti-inflammatory drug include non-steroidal anti-inflammatory drugs such as aspirin, acetaminophen, indomethacin and the like.

As the antithrombotic agent, for example, heparin (e.g., heparin sodium, heparin calcium, enoxaparin sodium, dalteparin sodium), warfarin (e.g., warfarin potassium), antithrombin drugs (e.g., aragatroban, dabigatran), FXa inhibitors (e.g., rivaroxaban, apixaban, edoxaban, YM150, compound described in WO02/06234, WO2004/048363, WO2005/030740, WO2005/058823 or WO2005/113504), thrombolytic agents (e.g., urokinase, tisokinase, alteplase, nateplase, monteplase, pamiteplase), platelet aggregation inhibitors (e.g., ticlopidine hydrochloride, clopidogrel, prasugrel, E5555, SHC530348, cilostazol, ethyl icosapentate, beraprost sodium, sarpogrelate hydrochloride) and the like can be mentioned.

Examples of the therapeutic agent for osteoporosis include alfacalcidol, calcitriol, elcatonin, calcitonin salmon, estriol, ipriflavone, pamidronate disodium, alendronate sodium hydrate, incadronate disodium, risedronate disodium and the like.

Examples of the vitamin include vitamin $B_1$, vitamin $B_{12}$ and the like.

Examples of the antidementia drug include tacrine, donepezil, rivastigmine, galanthamine and the like.

Examples of the erectile dysfunction drug include apomorphine, sildenafil citrate and the like.

Examples of the therapeutic drug for urinary frequency or urinary incontinence include flavoxate hydrochloride, oxybutynin hydrochloride, propiverine hydrochloride and the like.

Examples of the therapeutic agent for dysuria include acetylcholine esterase inhibitors (e.g., distigmine) and the like.

Examples of the central D2 receptor antagonist include typical psychotropic drugs (prochlorperazine, haloperidol, chlorpromazine, and the like), serotonin dopamine antagonists (perospirone, risperidone, and the like), and multi-acting receptor targeted antipsychotic drugs (olanzapine and the like).

Examples of the prokinetic agent include peripheral D2 receptor antagonists (metoclopramide, domperidone, and the like) and 5HT4 receptor agonists (mosapride and the like).

Examples of the antihistamine include hydroxyzine, diphenhydramine, and chlorpheniramine.

Examples of the muscarinic receptor antagonist include central muscarinic receptor antagonists (scopolamine and the like) and peripheral muscarinic receptor antagonists (butylscopolamine and the like).

Examples of the serotonin $5HT_3$ receptor antagonist include granisetron, ondansetron, azasetron, indisetron, palonosetron, and ramosetron.

Examples of the somatostatin analogue include octreotide.

Examples of the corticosteroid include dexamethasone, betamethasone, and methylprednisolone.

Examples of the benzodiazepine anxiolytic include lorazepam and alprazolam, examples of the NK-1 receptor antagonist include aprepitant and fosaprepitant, and examples of the hypercalcemia therapeutic drug include bisphosphonate.

Moreover, a drug confirmed to have a cachexia-ameliorating action either in animal models or clinically, i.e., a cyclooxygenase inhibitor (e.g., indomethacin), a progesterone derivative (e.g., megestrol acetate), glucocorticoid (e.g., dexamethasone), a metoclopramide drug, a tetrahydrocannabinol drug, an agent for improving fat metabolism (e.g., eicosapentaenoic acid), growth hormone, IGF-1, or an antibody against a cachexia-inducing factor TNF-α, LIF, IL-6 or oncostatin M or the like can also be used in combination with the compound of the present invention.

Alternatively, a glycation inhibitor (e.g., ALT-711), a nerve regeneration-promoting drug (e.g., Y-128, VX853, prosaptide), an antidepressant (e.g., desipramine, amitriptyline, imipramine), an antiepileptic drug (e.g., lamotrigine, Trileptal, Keppra, Zonegran, Pregabalin, Harkoseride, carbamazepine), an antiarrhythmic drug (e.g., mexiletine), an acetylcholine receptor ligand (e.g., ABT-594), an endothelin receptor antagonist (e.g., ABT-627), a monoamine uptake inhibitor (e.g., tramadol), a narcotic analgesic (e.g., morphine), a GABA receptor agonist (e.g., gabapentin, MR preparation of gabapentin), an α2 receptor agonist (e.g., clonidine), a local analgesic (e.g., capsaicin), an antianxiety drug (e.g., benzothiazepine), a phosphodiesterase inhibitor (e.g., sildenafil), a dopamine receptor agonist (e.g., apomorphine), midazolam, ketoconazole or the like may be used in combination with the compound of the present invention.

The time of administration of the compound of the present invention and that of the concomitant drug are not limited, and they may be administered simultaneously or in a staggered manner to the administration subject.

Examples of such administration mode include the following:
(1) administration of a single preparation obtained by simultaneously processing the compound of the present invention and the concomitant drug, (2) simultaneous administration of two kinds of preparations of the compound of the present invention and the concomitant drug, which have been separately produced, by the same administration route, (3) administration of two kinds of preparations of the compound of the present invention and the concomitant drug, which have been separately produced, by the same administration route in a staggered manner, (4) simultaneous administration of two kinds of preparations of the compound of the present invention and the concomitant drug, which have been separately produced, by different administration routes, (5) administration of two kinds of preparations of the compound of the present invention and the concomitant drug, which have been separately produced, by different administration routes in a staggered manner (e.g., administration in the order of the compound of the present invention and the concomitant drug, or in the reverse order) and the like.

The dose of the concomitant drug can be appropriately determined based on the dose employed in clinical situations. The mixing ratio of the compound of the present invention and a concomitant drug can be appropriately determined depending on the administration subject, symptom, administration method, target disease, combination and the like. When the subject of administration is human, for example, a concomitant drug can be used in 0.01 -100 parts by weight relative to 1 part by weight of the compound of the present invention.

By combining the compound of the present invention and concomitant drug:
(1) the dose of the compound of the present invention or a concomitant drug can be reduced as compared to single administration of the compound of the present invention or a concomitant drug, (2) the drug to be used in combination with the compound of the present invention can be selected depending on the condition of patients (mild, severe and the like),
(3) the period of treatment can be set longer by selecting a concomitant drug having different action and mechanism from those of the compound of the present invention,
(4) a sustained treatment effect can be designed by selecting a concomitant drug having different action and mechanism from those of the compound of the present invention,
(5) a synergistic effect can be afforded by a combined use of the compound of the present invention and a concomitant drug, and the like, can be achieved.

EXAMPLES

The abbreviations used in the present specification mean the following (Table 1). A hyphen in terms such as α-MePhe and the like as described herein may be omitted, and the event of omission also represents the same meaning.

In the amino acid sequences used in the present specification, the left terminal represents N terminal and the right terminal represents C terminal.

TABLE 1

| | |
|---|---|
| Ac | acetyl |
| Aib | α-aminoisobutyric acid |
| Ambz (4) | 4-aminomethylbenzoyl |
| GABA | γ-aminobutyric acid |
| Iva | isovaline |
| Lys (Ac) | Nε-acetyllysine |
| α-MePhe | α-methylphenylalanine |
| MeTyr | N-Methyltyrosine |

Hda, Doda, Trda, Teda, Peda, Heda, Hepda, Oda — dicarboxylic acid structures of increasing chain length (HOOC–(CH₂)ₙ–CO).

TABLE 1-continued
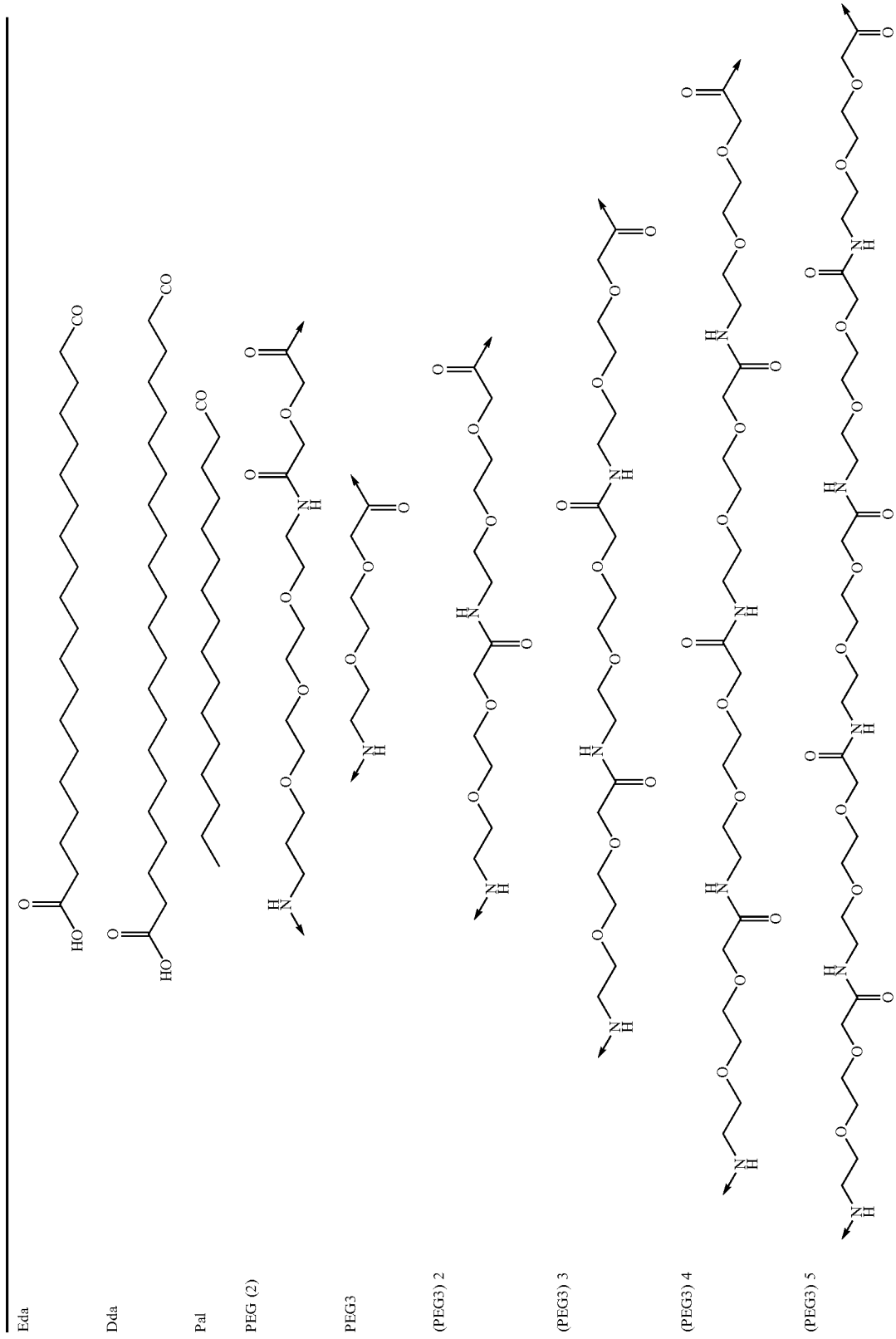

TABLE 1-continued
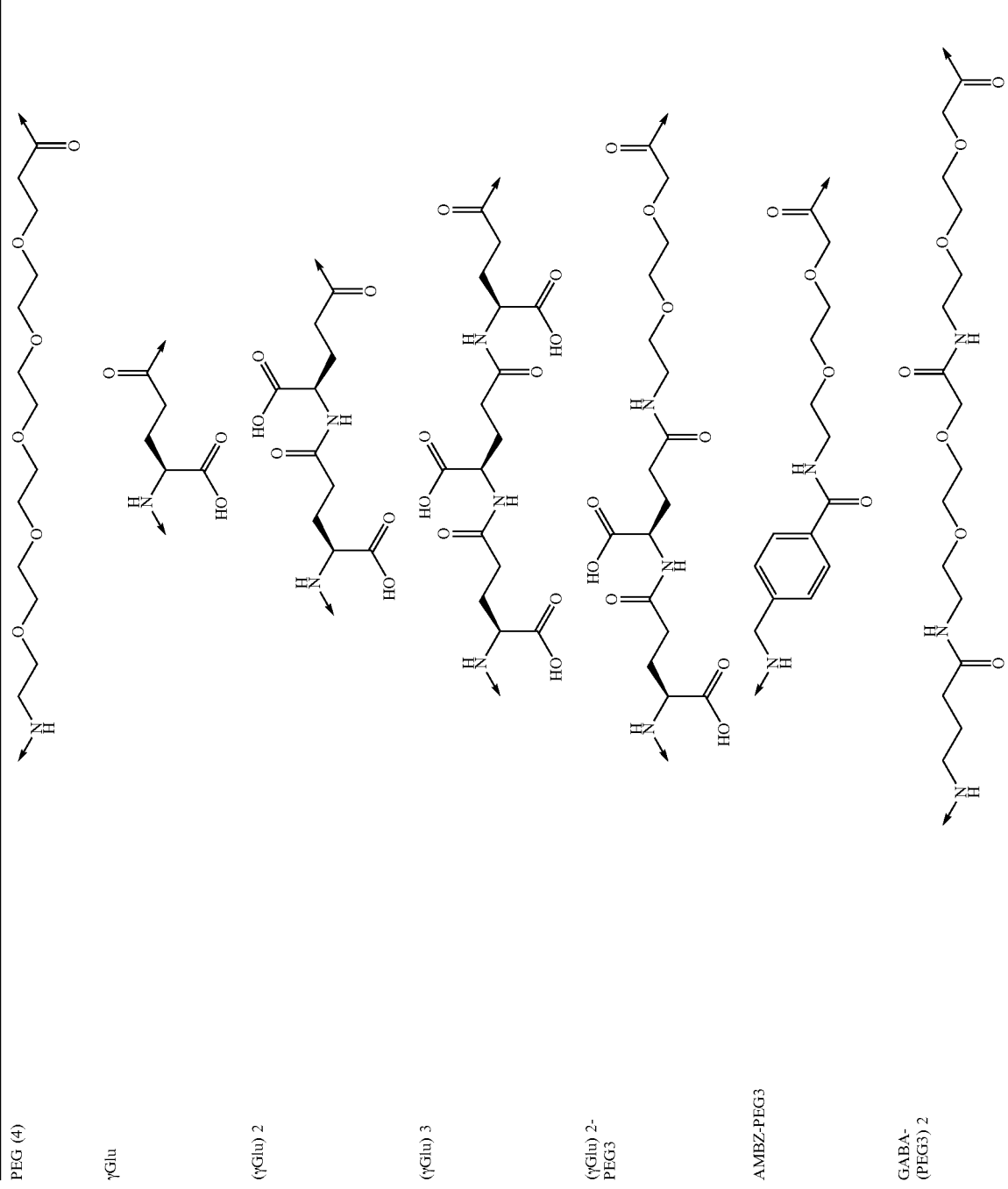

TABLE 1-continued
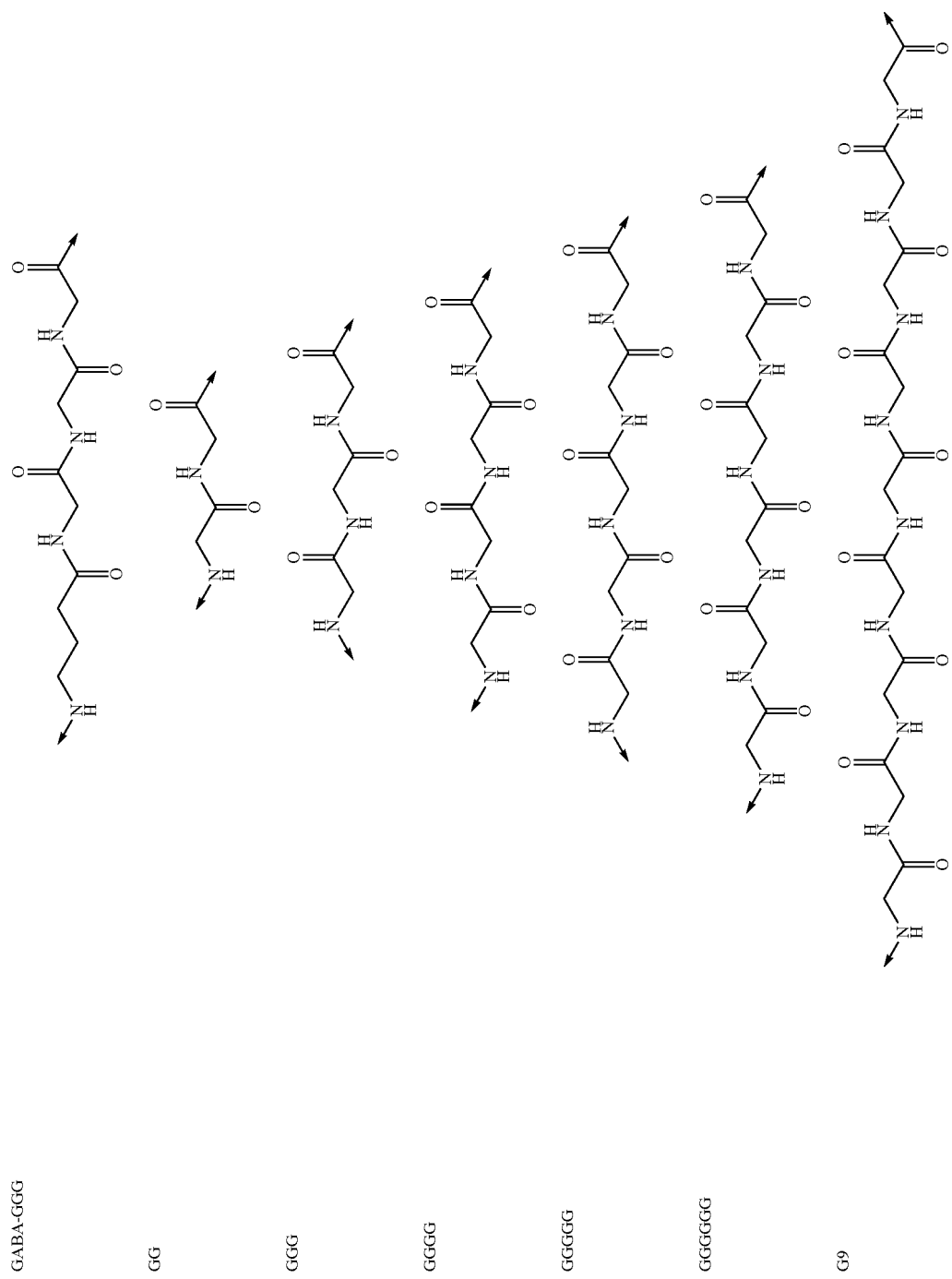

TABLE 1-continued
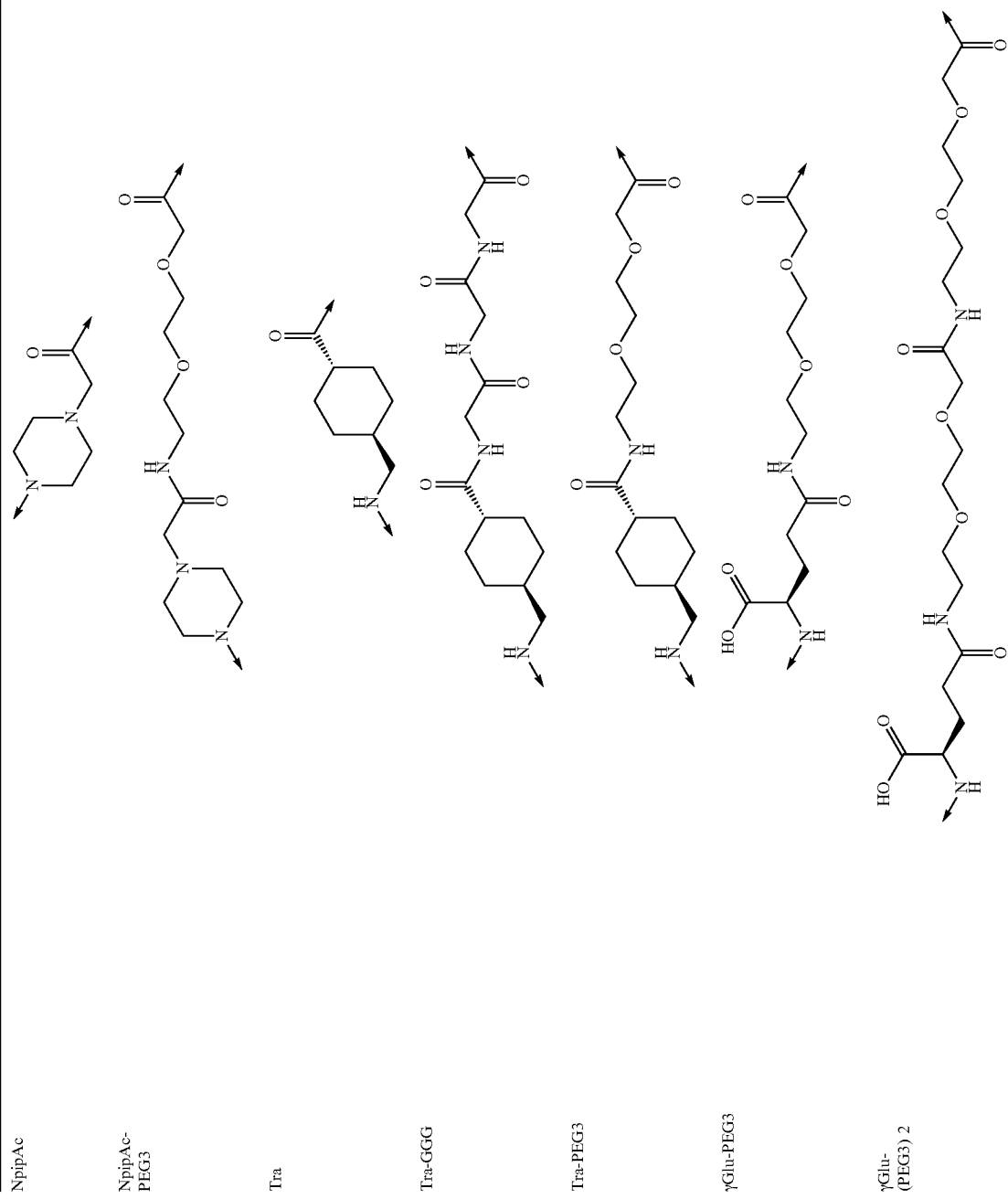
NpipAc
NpipAc-PEG3
Tra
Tra-GGG
Tra-PEG3
γGlu-PEG3
γGlu-(PEG3)2

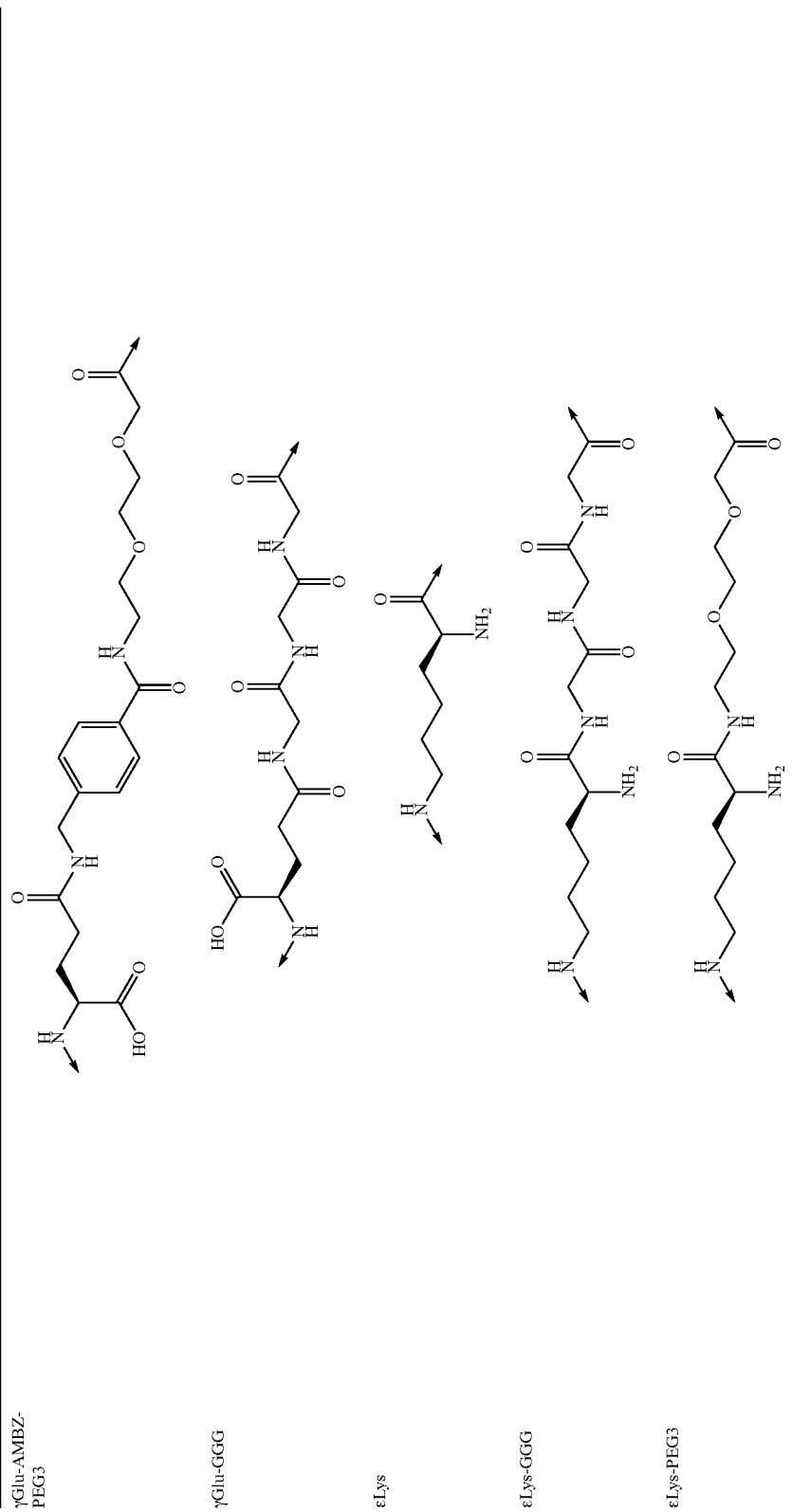

In the specification, where bases, amino acids, etc. are denoted by their codes, they are based on conventional codes in accordance with the IUPAC-IUB Commission on Biochemical Nomenclature or by the common codes in the art, examples of which are shown below. For amino acids that may have an optical isomer, L-form is presented unless otherwise indicated (e.g., "Ala" is L-form of Ala). In addition, "D-" means a D-form (e.g., "D-Ala" is D-form of Ala), and "DL-" means a racemate of a D-form and an L-form (e.g., "DL-Ala" is DL racemate of Ala).
TFA: trifluoroacetic acid
Gly or G: glycine
Ala or A: alanine
Val or V: valine
Leu or L: leucine
Ile or I: isoleucine
Ser or S: serine
Thr or T: threonine
Cys or C: cysteine
Met or M: methionine
Glu or E: glutamic acid
Asp or D: aspartic acid
Lys or K: lysine
Arg or R: arginine
His or H: histidine
Phe or F: phenylalanine
Tyr or Y: tyrosine
Trp or W: tryptophan
Pro or P: proline
Asn or N: asparagine
Gln or Q: glutamine The present invention is explained in detail in the following by referring to the following Reference Examples, Examples, Test Examples and Formulation Examples, which are mere embodiments and not to be construed as limitative. In addition, the present invention may be modified without departing from the scope of invention.

The term "room temperature" in the following Examples indicates the range of generally from about 10° C. to about 35° C. As for "%", the yield is in mol/mol%, the solvent used for chromatography is in % by volume and other "%" is in % by weight.
NMP: methylpyrrolidone
THF: tetrahydrofuran
DMF: N,N-dimethylformamide
WSC: 1-(3-dimethylaminopropyl)-3-ethylcarbodiimide hydrochloride
DCC: N,N'-Dicyclohexylcarbodiimide
DIPCDI: N,N'-diisopropylcarbodiimide
HOBt: 1-hydroxybenzotriazole monohydrate
Oxyma: ethyl 2-cyano-2-(hydroxyimino)acetate Reference Example 1

Synthesis of H-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin (SEQ ID NO: 4)

Sieber amide resin (0.61 meq/g, 410 mg) was added to a reaction tube, which was then loaded in a peptide synthesizer (ABI 433A). Amino acids were successively condensed according to the Fmoc/DCC/HOBt protocol. In the final step, the N-terminal Fmoc group was removed. After the termination of condensation, the resin was washed with MeOH, and dried under reduced pressure. As a result, 1137 mg (0.220 meq/g) of the protected peptide resin of interest was obtained.

Reference Example 2

Synthesis of H-Aib-Leu-Asp(OtBu)-Lys(Boc)-Gln(Trt)-Ala-Gln(Trt)-Aib-Glu(OtBu)-Phe-Val-Lys(Boc)-Trp(Boc)-Aib-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin (SEQ ID NO: 5)

Sieber amide resin (0.71 meq/g, 71 mg) was added to a reaction tube, which was then set in a peptide synthesizer. Amino acids were sequentially condensed according to the protocol using 20% piperidine/NMP [50° C., 5 minutes] to deprotect the Fmoc group and 5 equivalents of Fmoc-amino acids/DIPCDI/Oxyma [50° C., 15 minutes] to condense the Fmoc-amino acids. The condensation of Gln(Trt) at position 19 and Ala at position 18 was carried out by double coupling. The N-terminal Fmoc group was removed at the final step. After completion of the condensation, the resin was washed with MeOH and dried under reduced pressure. As a result, 264 mg (0.189 meq/g) of the protected peptide resin of interest was obtained.

Reference Example 3

Synthesis of H-Pro-Ser(tBu)-Ser(tBu)-Gly-Ala-Pro-Pro-Pro-Ser(tBu)-Arg(Pbf)-Sieber amide resin (SEQ ID NO: 6)

Sieber amide resin (0.71 mmol/g, 141 mg) was added to 5 reaction tubes, which were then set in a peptide synthesizer. Amino acids were sequentially condensed according to the protocol using 20% piperidine/NMP [50° C., 5 minutes] to deprotect the Fmoc group and 5 equivalents of Fmoc-amino acids/DIPCDI/Oxyma [50° C., 15 minutes] to condense the Fmoc-amino acids. After elongation, the resins in the respective reaction tubes were mixed, washed with MeOH, and dried under reduced pressure to thereby obtain 1282 mg of the protected peptide resin of interest H-Pro-Ser(tBu)-Ser(tBu)-Gly-Ala-Pro-Pro-Pro-Ser(tBu)-Arg(Pbf)-Sieber amide resin (0.394 mmol/g).

Reference Example A

Synthesis of H-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Sieber amide resin (SEQ ID NO: 481)

Sieber amide resin (0.71 meq/g, 1.40 g, 1.0 mmol) was added to a reaction tube, which was then set in a peptide synthesizer, and amino acids were sequentially extended according to the protocol using 20% piperidine/NMP [reacted at room temperature for 15 minutes] to deprotect the Fmoc group and 8 equivalents of Fmoc-amino acids/DIPCDI/Oxyma [reacted at room temperature for 150 minutes] to condense the Fmoc-amino acids. After elongation, the obtained resin was washed with MeOH, and dried under reduced pressure to thereby obtain 5.2064 g of the protected peptide resin of interest.

Reference Example B

Synthesis of Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Sieber amide resin (SEQ ID NO: 482)

Sieber amide resin (0.71 meq/g, 140.8 mg, 0.1 mmol) was added to a reaction tube, which was then set in a peptide synthesizer, and amino acids were sequentially extended according to the protocol using 20% piperidine/NMP [reacted at 50° C. for 5 minutes] to deprotect the Fmoc group and 5 equivalents of Fmoc-amino acids/DIPCDI/Oxyma [reacted at 50° C. for 15 minutes] to condense the Fmoc-amino acids. In this case, the condensation reaction of Boc-MeTyr(tBu) at position 1, Thr(tBu) at position 5, Ile at position 12, Arg(Pbf) at position 16, Gln(Trt) at position 19, and Trp(Boc) at position 25 was carried out at 50° C. for 30 minutes. The operation wherein the obtained Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)- Arg(Pbf)-Sieber amide resin was suspended in a 2% hydrazine/NMP solution, the resulting suspension was stirred at 50° C. for 10 minutes, and then the solution was removed by filtration was repeated 8 times to deprotect the ivDde group of Lys at position 14. The obtained resin was washed with MeOH, and dried under reduced pressure to thereby obtain 762.1 mg of Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys-Asp(OtBu)-Arg(Pbf)-Aib-Ala-Gln(Trt)-Aib-Asn(Trt)-Phe-Val-Asn(Trt)-Trp(Boc)-Iva-Leu- Ala-Gln(Trt)-Arg(Pbf)-Sieber amide resin.

Reference Example C

Synthesis of Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Pro- Ser(tBu)-Ser(tBu)-Gly-Ala-Pro-Pro-Pro-Ser(tBu)-Alko resin (SEQ ID NO: 483)

Fmoc-Ser(tBu)-Alko resin (0.68 meq/g, 147.1 mg, 0.1 mmol) was added to a reaction tube, which was then set in a peptide synthesizer, and amino acids were sequentially extended according to the protocol using 20% piperidine/NMP [reacted at room temperature for 15 minutes] to deprotect the Fmoc group and 5 equivalents of Fmoc-amino acids/DIPCDI/Oxyma [reacted at 50° C. for 15 minutes] to condense the Fmoc-amino acids. The operation wherein the obtained Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys(ivDde)-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Alko resin was suspended in a 2% hydrazine/NMP solution, the resulting suspension was stirred at 50° C. for 10 minutes, and then the solution was removed by filtration was repeated 8 times to deprotect the ivDde group of Lys at position 14. Subsequently, the resin was washed with MeOH, and dried under reduced pressure to thereby obtain 664.0 mg of the protected peptide resin of interest.

Example 1

Synthesis of H-Tyr-Aib-Glu-Gly-Thr-Val-Val-Ser-Leu-Tyr-Ser-Ile-Aib-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys-$NH_2$ (SEQ ID NO: 12) (Compound 6)

H-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin (0.220 meq/g, 46 mg) prepared in Reference Example 1 was weighed into a reaction tube, and swollen with DMF. After removal of DMF by filtration, Fmoc-Aib-OH (32.5 mg), 0.5 M Oxyma in DMF (200 μL) and diisopropylcarbodiimide (15.9 μL) were successively added to the resin, and then the mixture was shaken for 2 hours. The reaction solution was filtered off, and the resin was then washed with DMF 6 times. After confirmation of negativity in the Ninhydrin test, a DMF solution of 20% piperidine was added thereto, and the mixture was shaken for 1 minute. The solution was filtered off, and a DMF solution of 20% piperidine was then added thereto again, and the mixture was shaken for 20 minutes. The solution was filtered off, and the resin was then washed with DMF 10 times. This Fmoc amino acid condensation-Fmoc deprotection cycle was repeated to successively condense Gln(Trt), Ala, Gln(Trt), Lys(Boc), Asp(OtBu), Leu, Aib, Ile*, Ser(tBu), Tyr(tBu), Leu, Ser(tBu), Val, Val, Thr(tBu), Gly, Glu(OtBu), Aib and Tyr(tBu) (*: overnight reaction). The resin was washed with MeOH, and then dried under reduced pressure to give 64 mg of H-Tyr(tBu)-Aib-Glu(OtBu)-Gly-Thr(tBu)-Val-Val-Ser(tBu)-Leu-Tyr(tBu)-Ser(tBu)-Ile-Aib-Leu-Asp(OtBu)-Lys(Boc)-Gln(Trt)-Ala-Gln(Trt)-Aib-Glu(OtBu)-Phe-Val-Lys(Boc)-Trp(Boc)-Leu-Leu-Lys(Boc)-Gly-Gly-Pro-Ser(tBu)- Ser(tBu)-Gly-Ala-Pro-Pro-Pro-Ser(tBu)-Lys(Boc)-Sieber amide resin.

To 64 mg of the obtained resin was added 1 mL of TFA:m-cresol:thioanisole:ethanedithiol:$H_2O$:triisopropylsilane (80:5:5:5:2.5:2.5), and the mixture was stirred for 1.5 hours. The operation wherein diethyl ether was added to the reaction solution to obtain a precipitate and after centrifugation the supernatant was removed was repeated three times and thereby washed the precipitate. The residue was extracted with 50% aqueous acetic acid solution, and the resin was removed by filtration, followed by preparative HPLC using Daisopak SP-100-5-ODS-P column (250×20 mm I.D.) [Solution A: 0.1% TFA-water, Solution B: 0.1% TFA-containing acetonitrile, flow rate 8 mL/min, A/B: 63/37-53/47 linear concentration gradient elution (60 min)]. The fractions containing the object product were collected and freeze-dried to give 16.0 mg of a white powder.

Mass spectrometry, $(M+H)^+$ 4231.2 (Calculated: 4231.3)

HPLC elution time: 7.4 min elution condition:

column: Merck Chromolith Performance RP-18e (100×4.6 mm I.D.)

eluent: using Solution A: 0.1% TFA-water, Solution B: 0.1% TFA-containing acetonitrile, A/B: 95/5-35/65 linear concentration gradient elution (10 min)

flow rate: 3.0 mL/min

Example 2

Synthesis of H-Tyr-Aib-Glu-Gly-Thr-Val-Val-Ser-Leu-Tyr-Ser-Ile-Aib-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys-NH$_2$ (Acetate of Compound 6)

A powder (1084.2 mg) prepared in the same manner as in Example 1 was dissolved in a small amount of acetonitrile-water, an ion exchange resin (AG1 X8 resin (acetate form), 1.2 meq/mL, 2.1 mL) was added thereto, and the resulting mixture was allowed to stand for 1 hour while occasionally shaken. After removal of the resin by filtration, the filtrate was freeze-dried to thereby obtain 929.6 mg of a white powder.
Mass spectrometry result: (M+H)$^+$4231.3 (calculated 4231.3)
HPLC elution time: 7.5 minutes
Elution Conditions:
Column Chromolith Performance RP-18e (100×4.6 mm I.D.)
Eluents: Using solution A: 0.1% TFA-water and solution B: 0.1% TFA-containing acetonitrile, A/B: 95/5 to 35/65. Linear concentration gradient elution (10 minutes).
Flow rate: 3.0 mL/minute

Example 3

Synthesis of H-Tyr-Aib-Glu-Gly-Thr-Val-Val-Ser-Leu-Tyr-Ser-Ile-Aib-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys-NH$_2$ (Hydrochloride of Compound 6)

The powder prepared in Example 2 (73.0 mg) was dissolved in a small amount of acetonitrile-water and 1N hydrochloric acid (172 µL) was added thereto while ice cooled. After stirring at 0° C. for 2 hours, the resulting mixture was allowed to stand at 4° C. overnight. The obtained solution was freeze-dried to thereby obtain 71 mg of a white powder.
Mass spectrometry result: (M+H)$^+$4231.6 (calculated 4231.3)
HPLC elution time: 7.4 minutes
Elution Conditions:
Column Chromolith Performance RP-18e (100×4.6 mm I.D.)
Eluents: Using solution A: 0.1% TFA-water, solution B: 0.1% TFA-containing acetonitrile, A/B: 95/5 to 35/65. Linear concentration gradient elution (10 minutes).
Flow rate: 3.0 mL/minute

Example 4

Synthesis of H-Tyr-Aib-Glu-Gly-Thr-Val-Val-Ser-Phe-Tyr-Ser-Ile-Aib-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys-NH$_2$ (SEQ ID NO: 13) (Compound 7)

H-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin (0.220 meq/g, 46 mg) prepared in Reference Example 1 was weighed into a reaction tube, and swollen with DMF. After removal of DMF by filtration, Fmoc-Aib-OH (32.5 mg), 0.5 M Oxyma in DMF (200 µL) and diisopropylcarbodiimide (15.9 µL) were successively added to the resin, and then the mixture was shaken for 2 hours. The reaction solution was filtered off, and the resin was then washed with DMF 6 times. After confirmation of negativity in the Ninhydrin test, a DMF solution of 20% piperidine was added thereto, and the mixture was shaken for 1 minute. The solution was filtered off, and a DMF solution of 20% piperidine was then added thereto again, and the mixture was shaken for 20 minutes. The solution was filtered off, and the resin was then washed with DMF 10 times. This Fmoc amino acid condensation-Fmoc deprotection cycle was repeated to successively condense Gln(Trt), Ala, Gln(Trt), Lys(Boc), Asp(OtBu), Leu, Aib, Ile*, Ser(tBu), Tyr(tBu), Phe, Ser(tBu), Val, Val, Thr(tBu), Gly, Glu(OtBu), Aib and Tyr(tBu) (*: overnight reaction). The resin was washed with MeOH, and then dried under reduced pressure to give 74 mg of H-Tyr(tBu)-Aib-Glu(OtBu)-Gly-Thr(tBu)-Val-Val-Ser(tBu)-Phe-Tyr(tBu)-Ser(tBu)-Ile-Aib-Leu-Asp(OtBu)-Lys(Boc)-Gln(Trt)-Ala-Gln(Trt)-Aib-Glu(OtBu)-Phe-Val-Lys(Boc)-Trp(Boc)-Leu-Leu-Lys(Boc)-Gly-Gly-Pro-Ser(tBu)- Ser(tBu)-Gly-Ala-Pro-Pro-Pro-Ser(tBu)-Lys(Boc)-Sieber amide resin.
To 74 mg of the obtained resin was added 1 mL of TFA:m-cresol:thioanisole:ethanedithiol:H$_2$O:triisopropylsilane (80:5:5:5:2.5:2.5), and the mixture was stirred for 1.5 hours. The operation wherein diethyl ether was added to the reaction solution to obtain a precipitate and after centrifugation the supernatant was removed was repeated three times and thereby washed the precipitate. The residue was extracted with 50% aqueous acetic acid solution, and the resin was removed by filtration, followed by preparative HPLC using Daisopak SP-100-5-ODS-P column (250×20 mm I.D.) [Solution A: 0.1% TFA-water, Solution B: 0.1% TFA-containing acetonitrile, flow rate 8 mL/min, A/B: 63/37-53/47 linear concentration gradient elution (60 min)]. The fractions containing the object product were collected and freeze-dried to give 17.0 mg of a white powder.
Mass spectrometry, (M+H)$^+$4265.1 (Calculated: 4265.3)
HPLC elution time: 7.3 min
elution condition:
column: Merck Chromolith Performance RP-18e (100×4.6 mm I.D.)
eluent: using Solution A: 0.1% TFA-water, Solution B: 0.1% TFA-containing acetonitrile, A/B: 95/5-35/65 linear concentration gradient elution (10 min)
flow rate: 3.0 mL/min

Example 5

Synthesis of H-Tyr-Aib-Glu-Gly-Thr-Val-Lys-Ser-Asp-Tyr-Ser-Ile-Aib-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys-NH$_2$ (SEQ ID NO: 14) (Compound 8)

H-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin (0.220 meq/g, 46.0 mg) prepared in Reference Example 1 was weighed into a reaction tube, and swollen with DMF. After removal of DMF by filtration, Fmoc-Aib-OH (32.5 mg), 0.5 M Oxyma in DMF (200 µL) and diisopropylcarbodiimide (15.9 µL) were successively added to the resin, and then the mixture was shaken for 2 hours. The reaction solution was filtered off, and the resin was then washed with DMF 6 times. After confirmation of negativity in the Ninhydrin test, a DMF solution of 20% piperidine was added thereto, and the mixture was shaken for 1 minute. The solution was filtered off, and a DMF solution of 20% piperidine was then added thereto again, and the mixture was shaken for 20 minutes. The solution was filtered off, and the resin was then washed with DMF 10 times. This Fmoc amino acid condensation-Fmoc deprotection cycle was repeated to successively condense Gln(Trt), Ala, Gln(Trt), Lys(Boc), Asp(OtBu), Leu, Aib, Ile*, Ser(tBu), Tyr(tBu), Asp(OtBu), Ser(tBu), Lys(Boc), Val, Thr(tBu), Gly, Glu(OtBu), Aib and Tyr(tBu) (*: overnight reaction). The resin was washed with MeOH, and then dried under reduced pressure to give 73 mg of H-Tyr(tBu)-Aib-Glu(OtBu)-Gly-Thr(tBu)-Val-Lys(Boc)-Ser(tBu)-Asp(OtBu)-Tyr(tBu)-Ser(tBu)-Ile-Aib-Leu-Asp(OtBu)-Lys(Boc)-Gln(Trt)-Ala-Gln(Trt)-Aib-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin.

To 73 mg of the obtained resin was added 1 mL of TFA:m-cresol:thioanisole:ethanedithiol:$H_2O$:triisopropylsilane (80:5:5:5:2.5:2.5), and the mixture was stirred for 1.5 hours. The operation wherein diethyl ether was added to the reaction solution to obtain a precipitate and after centrifugation the supernatant was removed was repeated three times and and thereby washed the precipitate. The residue was extracted with 50% aqueous acetic acid solution, and the resin was removed by filtration, followed by preparative HPLC using Daisopak SP-100-5-ODS-P column (250×20 mm I.D.) [Solution A: 0.1% TFA-water, Solution B: 0.1% TFA-containing acetonitrile, flow rate 8 mL/min, A/B: 68/32-58/42 linear concentration gradient elution (60 min)]. The fractions containing the object product were collected and freeze-dried to give 15.7 mg of a white powder.
Mass spectrometry, $(M+H)^+$4262.3 (Calculated: 4262.3)
HPLC elution time: 6.6 min
elution condition:
column: Merck Chromolith Performance RP-18e (100×4.6 mm I.D.)
eluent: using Solution A: 0.1% TFA-water, Solution B: 0.1% TFA-containing acetonitrile, A/B: 95/5 -35/65 linear concentration gradient elution (10 min)
flow rate: 3.0 mL/min Example 6

H-Tyr-Aib-Glu-Gly-Thr-Val-Lys-Ser-Asp-Tyr-Ser-Ile-Leu-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys-$NH_2$ (SEQ ID NO: 15) (Compound 10)

H-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin (0.220 meq/g, 46 mg) prepared in Reference Example 1 was weighed into a reaction tube, and swollen with DMF. After removal of DMF by filtration, Fmoc-Aib-OH (32.5 mg), 0.5 M Oxyma in DMF (200 μL) and diisopropylcarbodiimide (15.9 μL) were successively added to the resin, and then the mixture was shaken for 2 hours. The reaction solution was filtered off, and the resin was then washed with DMF 6 times. After confirmation of negativity in the Ninhydrin test, a DMF solution of 20% piperidine was added thereto, and the mixture was shaken for 1 minute. The solution was filtered off, and a DMF solution of 20% piperidine was then added thereto again, and the mixture was shaken for 20 minutes. The solution was filtered off, and the resin was then washed with DMF 10 times. This Fmoc amino acid condensation-Fmoc deprotection cycle was repeated to successively condense Gln(Trt), Ala, Gln(Trt), Lys(Boc), Asp(OtBu), Leu, Leu, Ile*, Ser(tBu), Tyr(tBu), Asp(OtBu), Ser(tBu), Lys(Boc), Val, Thr(tBu), Gly, Glu(OtBu), Aib and Tyr(tBu) (*: overnight reaction). The resin was washed with MeOH, and then dried under reduced pressure to give 85 mg of H-Tyr(tBu)-Aib-Glu(OtBu)-Gly-Thr(tBu)-Val-Lys(Boc)-Ser(tBu)-Asp(OtBu)-Tyr(tBu)-Ser(tBu)-Ile-Leu-Leu-Asp(OtBu)-Lys(Boc)-Gln(Trt)-Ala-Gln(Trt)-Aib-Glu(OtBu)-Phe-Val-Lys(Boc)-Trp(Boc)-Leu-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin.

To 85 mg of the obtained resin was added 1 mL of TFA:m-cresol:thioanisole:ethanedithiol:$H_2O$:triisopropylsilane (80:5:5:5:2.5:2.5), and the mixture was stirred for 1.5 hours. The operation wherein diethyl ether was added to the reaction solution to obtain a precipitate and after centrifugation the supernatant was removed was repeated three times and thereby washed the precipitate. The residue was extracted with 50% aqueous acetic acid solution, and the resin was removed by filtration, followed by preparative HPLC using Daisopak SP-100-5-ODS-P column (250×20 mm I.D.) [Solution A: 0.1% TFA-water, Solution B: 0.1% TFA-containing acetonitrile, flow rate 8 mL/min, A/B: 67/33-57/43 linear concentration gradient elution (60 min)]. The fractions containing the object product were collected and freeze-dried to give 19.0 mg of a white powder.
Mass spectrometry, $(M+H)^+$4290.5 (Calculated: 4290.3)
HPLC elution time: 6.7 min
elution condition:
column: Merck Chromolith Performance RP-18e (100×4.6 mm I.D.)
eluent: using Solution A: 0.1% TFA-water, Solution B: 0.1% TFA-containing acetonitrile, A/B: 95/5 -35/65 linear concentration gradient elution (10 min)
flow rate: 3.0 mL/min Example 7

Synthesis of H-Tyr-Aib-Glu-Gly-Thr-Val-Val-Ser-Leu-Tyr-Ser-Ile-Aib-Leu-Asp-Lys-Gln-Ala-Gln-Aib-Glu-Phe-Val-Lys-Trp-Aib-Leu-Lys-Gly-Gly-Pro-Ser-Ser-Gly-Ala-Pro-Pro-Pro-Ser-Lys-$NH_2$ (SEQ ID NO: 50) (Compound 42)

H-Aib-Leu-Asp(OtBu)-Lys(Boc)-Gln(Trt)-Ala-Gln(Trt)-Aib-Glu(OtBu)-Phe-Val-Lys(Boc)-Trp (Boc)-Aib-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin (0.189 meq/g, 132 mg) prepared in Reference Example 2 was weighed into a reaction tube, which was then set in a peptide synthesizer. Amino acids were sequentially condensed according to the protocol using 20% piperidine/NMP [50° C., 5 minutes] to deprotect the Fmoc group and 5 equivalents of Fmoc-amino acids/DIPCDI/Oxyma [50° C., 15 minutes] to condense the Fmoc-amino acids. After completion of the condensation, the resin was washed with MeOH and dried under reduced pressure to thereby obtain 171 mg of H-Tyr(tBu)-Aib-Glu(OtBu)-Gly-Thr(tBu)-Val-Val-Ser(tBu)-Leu-Tyr(tBu)-Ser(tBu)-Ile-Aib-Leu-Asp(OtBu)-Lys(Boc)-Gln(Trt)-Ala-Gln(Trt)-Aib-Glu(OtBu)-Phe-Val-Lys(Boc)Trp(Boc)- Aib-Leu-Lys(Boc)-Gly-Gly-Pro-Ser(tBu)-Ser(tBu)-Gly-Ala-Pro-Pro-Pro-Ser(tBu)-Lys(Boc)-Sieber amide resin.

To 171 mg of the obtained resin was added 1 mL of TFA:m-cresol:thioanisole:ethanedithiol:$H_2O$:triisopropylsilane (80:5:5:5:2.5:2.5), and the mixture was stirred for 1.5 hours. The operation wherein diethyl ether was added to the reaction solution to obtain a precipitate and after centrifugation the supernatant was removed was repeated three times and thereby washed the precipitate. The residue was extracted with 50% aqueous acetic acid solution, and the resin was removed by filtration, followed by preparative HPLC using Daisopak SP-100-5-ODS-P column (250×20 mm I.D.) [Solution A: 0.1% TFA-water, Solution B: 0.1% TFA-containing acetonitrile, flow rate 8 mL/min, A/B: 65/35-55/45 linear concentration gradient elution (60 min)]. The fractions containing the object product were collected and freeze-dried to give 29.1 mg of a white powder.

Mass spectrometry, $(M+H)^+$4202.4 (Calculated: 4203.3)

HPLC elution time: 7.3 min elution condition:

column: Merck Chromolith Performance RP-18e (100×4.6 mm I.D.)

eluent: using Solution A: 0.1% TFA-water, Solution B: 0.1% TFA-containing acetonitrile, A/B: 95/5 -35/65 linear concentration gradient elution (10 min)

flow rate: 3.0 mL/min

Example 8

Synthesis of H-Tyr-Aib-Glu-Gly-Thr-Val-Val-Ser-
Leu-Tyr-Ser-Ile-Aib-Leu-Asp-Arg-Gln-Ala-Gln-
Aib-Glu-Phe-Val-Arg-Trp-Leu-Leu-Arg-Gly-Gly-
Pro-Ser-Ser-Gly-Ala-Pro-Pro-Pro-Ser-Arg-NH$_2$
(SEQ ID NO: 36) (Compound 30)

Sieber amide resin (0.7 mmol/g, 149 mg) was added to 2 reaction tubes, which were then set in a peptide synthesizer. Amino acids were sequentially condensed according to the protocol using 20% piperidine/NMP [50° C., 5 minutes] to deprotect the Fmoc group and 5 equivalents of Fmoc-amino acids/DIPCDI/Oxyma [50° C., 15 minutes] to condense the Fmoc-amino acids. After elongation, the resins were washed with MeOH and dried under reduced pressure to thereby obtain 1308 mg of the protected peptide resin of interest H-Tyr(tBu)-Aib-Glu(OtBu)-Gly-Thr(tBu)-Val-Val-Ser(tBu)-Leu-Tyr(tBu)-Ser(tBu)-Ile-Aib-Leu-Asp(OtBu)-Arg(Pbf)-Gln(Trt)-Ala-Gln(Trt)-Aib-Glu(OtBu)-Phe-Val-Arg(Pbf)-Trp(Boc)-Leu-Leu-Arg(Pbf)-Gly-Gly-Pro- Ser(tBu)-Ser(tBu)-Gly-Ala-Pro-Pro-Pro-Ser(tBu)-Arg(Pbf)-sieber amide resin. To the total amount of the obtained resins, 15 mL of TFA:m-cresol:thioanisole:ethandithiol:H$_2$O:triisopropylsilane (80:5:5:5:2.5:2.5) was added and the resulting mixture was stirred for 1.5 hours. The operation wherein diethyl ether was added to the reaction solution to obtain a precipitate and after centrifugation the supernatant was removed was repeated twice and thereby washed the precipitate. The residue was extracted with a 50% acetic acid aqueous solution and after removal of the resin by filtration, the purification was carried out several times by preparative HPLC using a daisopak SP-100-5-ODS-P column (250×20 mm I.D.) by the linear concentration gradient elution (60 minutes) with solution A: 0.1% TFA-water and solution B: 0.1% TFA-containing acetonitrile at a flow rate of 8 mL/minute from A/B: 62/38 to 52/48, and fractions containing the product of interest were collected and freeze-dried to thereby obtain 190.1 mg of a white powder.

The obtained powder (190.1 mg) was dissolved in a small amount of an acetonitrile aqueous solution. An ion exchange resin (AG1 X8 resin (acetate form), 1.2 meq/mL, 365 μL) was added to the solution, which was then allowed to stand for 1 hour while occasionally shaken. After removal of the resin by filtration, the filtrate was freeze-dried to thereby obtain 159.2 mg of a white powder.

Mass spectrometry result: $(M+H)^+$4343.3 (calculated 4343.3)

HPLC elution time: 7.5 minutes

Elution Conditions:

Column Merck Chromolith Performance RP-18e (4.6× 100 mm I.D.)

Eluents: Using solution A: 0.1% TFA-water and solution B: 0.1% TFA-containing acetonitrile, A/B: 95/5 to 35/65. Linear concentration gradient elution (10 minutes).

Flow rate: 3.0 mL/minute

Example 9

Synthesis of Methyl-Tyr-Aib-Glu-Gly-Thr-Phe-Ile-
Ser-Asp-Tyr-Ser-Ile-Ala-Leu-Asp-Arg-Ile-Ala-Gln-
Gln-Asp-Phe-Val-Asn-Trp-Leu-Leu-Ala-Gln-Arg-
Pro-Ser-Ser-Gly-Ala-Pro-Pro-Pro-Ser-Arg-NH$_2$
(SEQ ID NO: 65) (Compound 59)

H-Pro-Ser(tBu)-Ser(tBu)-Gly-Ala-Pro-Pro-Pro-Ser(tBu)-Arg(Pbf)-Sieber amide resin (0.394 mmol/g, 127 mg) prepared in Reference Example 3 was added to a reaction tube, which was then set in a peptide synthesizer. Amino acids were sequentially condensed according to the protocol using 20% piperidine/NMP [50° C., 5 minutes] to deprotect the Fmoc group and 5 equivalents of Fmoc-amino acids/DIPCDI/Oxyma [50° C., 15 minutes] to condense the Fmoc-amino acids. After elongation, the resin was washed with MeOH and dried under reduced pressure to thereby obtain the protected peptide resin of interest Boc-Me-Tyr(tBu)-Aib-Glu(OtBu)-Gly-Thr(tBu)-Phe-Ile-Ser(tBu)-Asp(OtBu)-Tyr(tBu)-Ser(tBu)-Ile-Ala-Leu-Asp(OtBu)-Arg(Pbf)-Ile-Ala-Gln(Trt)-Gln(Trt)-Asp(OtBu)-Phe-Val-Asn(Trt)-Trp (Boc)-Leu-Leu-Ala-Gln(Trt)-Arg(Pbf)-Pro- Ser(tBu)-Ser(tBu)-Gly-Ala-Pro-Pro-Pro-Ser(tBu)-Arg(Pbf)-Sieber amide resin. To the total amount of the obtained resin, 3.5 mL of TFA:m-cresol:thioanisole:ethandithiol:H$_2$O:triisopropylsilane (80:5:5:5:2.5:2.5) was added and the resulting mixture was stirred for 1.5 hours. The operation wherein diethyl ether was added to the reaction solution to obtain a precipitate and after centrifugation the supernatant was removed was repeated twice and thereby washed the precipitate. The residue was extracted with a 50% acetic acid aqueous solution and after removal of the resin by filtration, the purification was carried out by preparative HPLC using a daisopak SP-100-5-ODS-P column (250×20 mm I.D.) by the linear concentration gradient elution (60 minutes) with solution A: 0.1% TFA-water and solution B: 0.1% TFA-containing acetonitrile at a flow rate of 8 mL/minute from A/B: 60/40 to 50/50, and fractions containing the product of interest were collected and freeze-dried to thereby obtain 71.4 mg of a white powder.

The total amount of the obtained powder was dissolved in a small amount of an acetonitrile aqueous solution. An ion exchange resin (AG1 X8 resin (acetate form), 1.2 meq/mL, 67 μL) was added to the solution, which was then allowed to stand for 1 hour while occasionally shaken. After removal of the resin by filtration, the filtrate was freeze-dried to thereby obtain 59.0 mg of a white powder.

Mass spectrometry result: $(M+H)^+$4464.8 (calculated 4464.3)

HPLC elution time: 7.8 minutes

Elution Conditions:

Column Merck Chromolith Performance RP-18e (4.6× 100 mm I.D.)

Eluents: Using solution A: 0.1% TFA-water, solution B: 0.1% TFA-containing acetonitrile, A/B: 95/5 to 35/65. Linear concentration gradient elution (10 minutes).

Flow rate: 3.0 mL/minutes

Example 10

Synthesis of Methyl-Tyr-Aib-Glu-Gly-Thr-Iva-Ile-Ser-Asp-Tyr-Ser-Ile-Ala-Leu-Asp-Arg-Aib-Ala-Gln-Aib-Asn-Phe-Val-Asn-Trp-Leu-Leu-Ala-Gln-Arg-Pro-Ser-Ser-Gly-Ala-Pro-Pro-Pro-Ser-Arg-NH$_2$ (SEQ ID NO: 110) (Compound 104)

H-Pro-Ser(tBu)-Ser(tBu)-Gly-Ala-Pro-Pro-Pro-Ser(tBu)-Arg(Pbf)-Sieber amide resin (0.394 mmol/g, 127 mg) prepared in Reference Example 3 was added to a reaction tube, which was then set in a peptide synthesizer. Amino acids were sequentially condensed according to the protocol using 20% piperidine/NMP [50° C., 5 minutes] to deprotect the Fmoc group and 5 equivalents of Fmoc-amino acids/DIP-CDI/Oxyma [50° C., 15 minutes] to condense the Fmoc-amino acids. After elongation, the resin was washed with MeOH and dried under reduced pressure to thereby obtain the protected peptide resin of interest Boc-Me-Tyr(tBu)-Aib-Glu(OtBu)-Gly-Thr(tBu)-Iva-Ile-Ser(tBu)-Asp(OtBu)-Tyr(tBu)-Ser(tBu)-Ile-Ala-Leu-Asp(OtBu)-Arg(Pbf)-Aib-Ala-Gln(Trt)-Aib-Asn(Trt)-Phe-Val-Asn(Trt)-Trp(Boc)-Leu-Leu-Ala-Gln(Trt)-Arg(Pbf)-Pro-Ser(tBu)- Ser(tBu)-Gly-Ala-Pro-Pro-Pro-Ser(tBu)-Arg(Pbf)-Sieber amide resin. To the total amount of the obtained resin, 4 mL of TFA:m-cresol:thioanisole:ethandithiol:H$_2$O:triisopropylsilane (80:5:5:5:2.5:2.5) was added and the resulting mixture was stirred for 1.5 hours. The operation wherein diethyl ether was added to the reaction solution to obtain a precipitate and after centrifugation the supernatant was removed was repeated twice and thereby washed the precipitate. The residue was extracted with a 50% acetic acid aqueous solution and after removal of the resin by filtration, the purification was carried out by preparative HPLC using a daisopak SP-100-5-ODS-P column (250×20 mm I.D.) by the linear concentration gradient elution (60 minutes) with solution A: 0.1% TFA-water and solution B: 0.1% TFA-containing acetonitrile at a flow rate of 8 mL/minute from A/B: 62/38 to 5²/₄8, and fractions containing the product of interest were collected and freeze-dried to thereby obtain 81 mg of a white powder.

The total amount of the obtained powder was dissolved in a small amount of an acetonitrile aqueous solution. An ion exchange resin (AG1 X8 resin (acetate form), 1.2 meq/mL, 78 μL) was added to the solution, which was then allowed to stand for 1 hour while occasionally shaken. After removal of the resin by filtration, the filtrate was freeze-dried to thereby obtain 53.2 mg of a white powder.

Mass spectrometry result: (M+H)$^+$4345.1 (calculated 4344.3)

HPLC elution time: 7.7 minutes

Elution Conditions:

Column Merck Chromolith Performance RP-18e (4.6× 100 mm I.D.)

Eluents: Using solution A: 0.1% TFA-water, solution B: 0.1% TFA-containing acetonitrile, A/B: 95/5 to 35/65. Linear concentration gradient elution (10 minutes).

Flow rate: 3.0 mL/minutes

Example 11

Synthesis of Methyl-Tyr-Aib-Glu-Gly-Thr-Iva-Ile-Ser-Asp-Tyr-Ser-Ile-Aib-Leu-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$ (SEQ ID NO: 119) (Compound 113)

H-Pro-Ser(tBu)-Ser(tBu)-Gly-Ala-Pro-Pro-Pro-Ser(tBu)-Arg(Pbf)-Sieber amide resin (0.394 mmol/g, 127 mg) prepared in Reference Example 3 was added to a reaction tube, which was then set in a peptide synthesizer. Amino acids were sequentially condensed according to the protocol using 20% piperidine/NMP [50° C., 5 minutes] to deprotect the Fmoc group and 5 equivalents of Fmoc-amino acids/DIP-CDI/Oxyma [50° C., 15 minutes] to condense the Fmoc-amino acids. After elongation, the resin was washed with MeOH and dried under reduced pressure to thereby obtain the protected peptide resin of interest Boc-Me-Tyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Leu-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)- Ser(tBu)-Gly-Ala-Pro-Pro-Pro-Ser(tBu)-Arg(Pbf)-Sieber amide resin. To the total amount of the obtained resin, 4 mL of TFA:m-cresol:thioanisole:ethandithiol:H$_2$O:triisopropylsilane (80:5:5:5:2.5:2.5) was added and the resulting mixture was stirred for 1.5 hours. The operation wherein diethyl ether was added to the reaction solution to obtain a precipitate and after centrifugation the supernatant was removed was repeated twice and thereby washed the precipitate. The residue was extracted with a 50% acetic acid aqueous solution and after removal of the resin by filtration, the purification was carried out by preparative HPLC using a daisopak SP-100-5-ODS-P column (250×20 mm I.D.) by the linear concentration gradient elution (60 minutes) with solution A: 0.1% TFA-water and solution B: 0.1% TFA-containing acetonitrile at a flow rate of 8 mL/minute from A/B: 61/39 to 51/49, and fractions containing the product of interest were collected and freeze-dried to thereby obtain 71.1 mg of a white powder.

The total amount of the obtained powder was dissolved in a small amount of an acetonitrile aqueous solution. An ion exchange resin (AG1 X8 resin (acetate form), 1.2 meq/mL, 68 μL) was added to the solution, which was then allowed to stand for 1 hour while occasionally shaken. After removal of the resin by filtration, the filtrate was freeze-dried to thereby obtain 62.8 mg of a white powder.

Mass spectrometry result: (M+H)$^+$4345.0 (calculated 4344.3)

HPLC elution time: 7.6 minutes

Elution Conditions:

Column Merck Chromolith Performance RP-18e (4.6× 100 mm I.D.)

Eluents: Using solution A: 0.1% TFA-water, solution B: 0.1% TFA-containing acetonitrile, A/B: 95/5 to 35/65. Linear concentration gradient elution (10 minutes).

Flow rate: 3.0 mL/minutes

Example 12

Synthesis of Methyl-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$ (SEQ ID NO: 123) (Compound 117)

Sieber amide resin (0.71 mmol/g, 352 mg) was added to a reaction tube, which was then set in a peptide synthesizer.

Amino acids were sequentially condensed according to the protocol using 20% piperidine/NMP [50° C., 5 minutes] to deprotect the Fmoc group and 5 equivalents of Fmoc-amino acids/DIPCDI/Oxyma [50° C., 15 minutes] to condense the Fmoc-amino acids. After elongation, the resin was washed with MeOH and dried under reduced pressure to thereby obtain the protected peptide resin of interest Boc-Me-Tyr(tBu)-Aib-Glu(OtBu)-Gly-Thr(tBu)-Phe-Ile-Ser(tBu)-Asp(OtBu)-Tyr(tBu)-Ser(tBu)-Ile-Ala-Leu-Asp(OtBu)-Arg(Pbf)-Aib-His(Trt)-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Arg(Pbf)-Sieber amide resin. To the total amount of the obtained resin, 4 mL of TFA:m-cresol:thioanisole:ethandithiol:H$_2$O:triisopropylsilane (80:5:5:5:2.5:2.5) was added and the resulting mixture was stirred for 1.5 hours at room temperature. The operation wherein diethyl ether was added to the reaction solution to obtain a precipitate and after centrifugation the supernatant was removed was repeated twice and thereby washed the precipitate. The residue was extracted with a 50% acetic acid aqueous solution and after removal of the resin by filtration, the purification was carried out by preparative HPLC using a daisopak SP-100-5-ODS-P column (250×20 mm I.D.) by the linear concentration gradient elution (60 minutes) with solution A: 0.1% TFA-water and solution B: 0.1% TFA-containing acetonitrile at a flow rate of 8 mL/minute from A/B: 69/31 to 59/41, and fractions containing the product of interest were collected and freeze-dried to thereby obtain 190.8 mg of a white powder.

The total amount of the obtained powder was dissolved in a small amount of an acetonitrile aqueous solution. An ion exchange resin (AG1 X8 resin (acetate form), 1.2 meq/mL, 179 μL) was added to the solution, which was then allowed to stand for 1 hour while occasionally shaken. After removal of the resin by filtration, the filtrate was freeze-dried to thereby obtain 170.0 mg of a white powder.

Mass spectrometry result: (M+H)$^+$4443.3 (calculated 4444.3)

HPLC elution time: 6.5 minutes

Elution Conditions:

Column Merck Chromolith Performance RP-18e (4.6×100 mm I.D.)

Eluents: Using solution A: 0.1% TFA-water, solution B: 0.1% TFA-containing acetonitrile, A/B: 95/5 to 35/65. Linear concentration gradient elution (10 minutes).

Flow rate: 3.0 mL/minutes

Example 13

Synthesis of H-MeTyr-Aib-Glu-Gly-Thr-Iva-Ile-Ser-Asp-Tyr-Ser-Ile-Aib-Lys(Eda-GGGGG-)-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$ (SEQ ID NO: 354) (Compound 341)

H-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Sieber amide resin (SEQ ID NO: 481) (260.4 mg, 0.05 mmol) synthesized in Reference Example A was weighed into a reaction tube, which was then set in a peptide synthesizer. Amino acids were sequentially extended according to the protocol using 20% piperidine/NMP [reacted at 50° C. for 5 minutes] to deprotect the Fmoc group and 5 equivalents of Fmoc-amino acids/DIPCDI/Oxyma [reacted at 50° C. for 15 minutes] to condense the Fmoc-amino acids. In this case, the condensation reaction of Boc-MeTyr(tBu) at position 1, Thr(tBu) at position 5, Ile at position 12, Arg(Pbf) at position 16, Gln(Trt) at position 19, and Trp(Boc) at position 25 was carried out at 50° C. for 30 minutes. The operation wherein the obtained Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys(ivDde)-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Sieber amide resin was suspended in a 2% hydrazine/NMP solution, the resulting suspension was stirred at 50° C. for 10 minutes, and then the solution was removed by filtration was repeated 8 times to deprotect the ivDde group of Lys at position 14. Subsequently, Fmoc-Gly-Gly-Gly-OH was introduced using the peptide synthesizer and then Gly, Gly, and eicosanedioic acid were sequentially introduced. In this case, 20% piperidine/NMP was used [reacted at 50° C. for 5 minutes] to deprotect the Fmoc group, and the condensation reaction was carried out using the double coupling method in which after all the reactions at 50° C. for 15 minutes, the solution was removed by filtration, and the same condensation reaction was repeated. After completion of solid-phase synthesis, the resin was washed with MeOH, and dried under reduced pressure to thereby obtain 421.5 mg of the protected peptide resin of interest, Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys(Eda-GGGGG-)-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Sieber amide resin. To the total amount of the obtained resin, 4.6 mL of TFA:m-cresol:thioanisole:ethandithiol:H$_2$O:triisopropylsilane (80:5:5:5:2.5:2.5) was added and the resulting mixture was stirred for 1.5 hours. Diethyl ether was added to the reaction solution to obtain a precipitate and after centrifugation the supernatant was removed. This operation was repeated twice and the precipitate was washed. The residue was extracted with a 90% acetic acid aqueous solution and the resin was removed by filtration, and then the purification was carried out by preparative HPLC using Phenomenex Kinetex 5 μm XB-C18 (250×30.0 mm I.D.) by the linear concentration gradient elution (60 minutes) with solution A: 0.1% TFA-water and solution B: 0.1% TFA-containing acetonitrile at a flow rate of 15 mL/minute from A/B: 40/60 to 50/50, and fractions containing the product of interest were collected and freeze-dried to thereby obtain 70.1 mg of a white powder.

Subsequently, the total amount of the obtained powder was dissolved in 50% acetonitrile-water, an ion exchange resin [AG1X8 resin (acetate form), 1.2 meq/mL, 182 μL] was added to the solution, and the resulting mixture was shaken for 1 hour. After removal of the resin by filtration, the filtrate was freeze-dried to thereby obtain 58.8 mg of the acetate of the product of interest.

Mass spectrometry result: (M+H)$^+$4811.57 (calculated 4812.54)

HPLC elution time: 6.19 minutes

Elution conditions:

Column: Kinetex 1.7 μm C8 100A, (100×2.1 mm I.D.)

Eluents: Using solution A: 0.1% TFA-water, solution B: 0.1% TFA-containing acetonitrile, A/B: 80/20 to 30/70. Linear concentration gradient elution (10 minutes).

Flow rate: 0.5 mL/minutes

Temperature: 40° C.

Example 14

Synthesis of H-MeTyr-Aib-Glu-Gly-Thr-Iva-Ile-Ser-Asp-Tyr-Ser-Ile-Aib-Leu-Asp-Arg-Lys(Oda-GGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$ (SEQ ID NO: 362) (Compound 349)

H-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Sieber amide resin (SEQ ID NO: 481) (520.0 mg, 0.1 mmol) synthesized in Reference Example A was weighed into a reaction tube, which was then set in a peptide synthesizer. Amino acids were sequentially extended according to the protocol using 20% piperidine/NMP [reacted at 50° C. for 5 minutes] to deprotect the Fmoc group and 5 equivalents of Fmoc-amino acids/DIPCDI/Oxyma [reacted at 50° C. for 15 minutes] to condense the Fmoc-amino acids. In this case, the condensation reaction of Boc-MeTyr(tBu) at position 1, Thr(tBu) at position 5, Ile at position 12, Gln(Trt) at position 19, and Trp(Boc) at position 25 was carried out at 50° C. for 30 minutes. The operation wherein the obtained Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Leu-Asp(OtBu)-Arg(Pbf)-Lys(ivDde)-Ala-Gln(Trt)-Aib-Asn(Trt)-Phe-Val-Asn(Trt)-Trp(Boc)-Iva-Leu-Ala-Gln(Trt)-Arg(Pbf)-Pro- Ser(tBu)-Ser(tBu)-Gly-Ala-Pro-Pro-Pro-Ser(tBu)-Sieber amide resin was suspended in a 2% hydrazine/NMP solution, the resulting suspension was stirred at 50° C. for 10 minutes, and then the solution was removed by filtration was repeated 8 times to deprotect the ivDde group of Lys at position 17. Subsequently, Fmoc-Gly-Gly-Gly-OH was introduced using the peptide synthesizer and then Gly, Gly, and octadecanedioic acid were sequentially introduced. In this case, 20% piperidine/NMP was used [reacted at 50° C. for 5 minutes] to deprotect the Fmoc group, and the condensation reaction was carried out using the double coupling method in which after all the reactions at 50° C. for 15 minutes, the solution was removed by filtration, and the same condensation reaction was repeated. After completion of solid-phase synthesis, the resin was washed with MeOH, and dried under reduced pressure to thereby obtain 817.0 mg of the protected peptide resin of interest, Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Leu-Asp(OtBu)-Arg(Pbf)-Lys(Oda-GGGGG-)-Ala-Gln(Trt)-Aib-Asn(Trt)-Phe-Val-Asn(Trt)-Trp(Boc)-Iva-Leu-Ala- Gln(Trt)-Arg(Pbf)-Pro-Ser(tBu)-Ser(tBu)-Gly-Ala-Pro-Pro-Pro-Ser(tBu)-Sieber amide resin. To the total amount of the obtained resin, 8 mL of TFA:m-cresol:thioanisole:ethandithiol:H$_2$O:triisopropylsilane (80:5:5:5:2.5:2.5) was added and the resulting mixture was stirred for 1.5 hours. Diethyl ether was added to the reaction solution to obtain a precipitate and after centrifugation the supernatant was removed. This operation was repeated twice and the precipitate was washed. The residue was extracted with a 90% acetic acid aqueous solution and the resin was removed by filtration, and then the purification was carried out by preparative HPLC using Phenomenex Kinetex 5 µm XB-C18 (250×30.0 mm I.D.) by the linear concentration gradient elution (60 minutes) with solution A: 0.1% TFA-water and solution B: 0.1% TFA-containing acetonitrile at a flow rate of 15 mL/minute from A/B: 40/60 to 50/50, and fractions containing the product of interest were collected and freeze-dried to thereby obtain 109.2 mg of a white powder.

Subsequently, the total amount of the obtained powder was dissolved in 50% acetonitrile-water, an ion exchange resin [AG1X8 resin (acetate form), 1.2 meq/mL, 285 µL] was added to the solution, and the resulting mixture was shaken for 1 hour. After removal of the resin by filtration, the filtrate was freeze-dried to thereby obtain 93.1 mg of the acetate of the product of interest.

Mass spectrometry result: (M+H)$^+$4810.655 (calculated 4812.54)

HPLC elution time: 6.09 minutes

Elution Conditions:
Column: Kinetex 1.7 µm C8 100A, (100×2.1 mm I.D.)
Eluents: Using solution A: 0.1% TFA-water, solution B: 0.1% TFA-containing acetonitrile, A/B: 80/20 to 30/70. Linear concentration gradient elution (10 minutes).
Flow rate: 0.5 mL/minutes
Temperature: 40° C.

Example 15

Synthesis of Ac-Tyr-Aib-Glu-Gly-Thr-Iva-Ile-Ser-Asp-Tyr-Ser-Ile-Aib-Lys(Eda-GGGGG-)-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$ (SEQ ID NO: 448) (Compound 435)

Sieber amide resin (0.71 meq/g, 70.4 mg, 0.05 mmol) was added to a reaction tube, and amino acids were sequentially extended to the N-terminal according to the protocol using 20% piperidine/NMP [reacted at 50° C. for 5 minutes] to deprotect the Fmoc group and 5 equivalents of Fmoc-amino acids/DIPCDI/Oxyma [reacted at 50° C. for 15 minutes] to condense the Fmoc-amino acids. In this case, the condensation reaction of Boc-MeTyr(tBu) at position 1, Thr(tBu) at position 5, Ile at position 12, Arg(Pbf) at position 16, Gln(Trt) at position 19, and Trp(Boc) at position 25 was carried out at 50° C. for 30 minutes. To the obtained H-Tyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys(ivDde)-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Pro- Ser(tBu)-Ser(tBu)-Gly-Ala-Pro-Pro-Pro-Ser(tBu)-Sieber amide resin, 0.625 ml of a mixed solution in which 0.5 M acetic anhydride, 0.5 M pyridine and 0.05 M Oxyma were dissolved in NMP was added, and the resulting mixture was reacted at 50° C. for 2 minutes. After the resin was washed with NMP, the operation wherein the resin was suspended in a 2% hydrazine/NMP solution, the resulting suspension was stirred at 50° C. for 10 minutes, and then the solution was removed by filtration was repeated 8 times to deprotect the ivDde group of Lys at position 14. Subsequently, Gly, Gly, Fmoc-Gly-Gly-Gly-OH, and eicosanedioic acid were sequentially introduced using the peptide synthesizer. In this case, 20% piperidine/NMP was used [reacted at 50° C. for 5 minutes] to deprotect the Fmoc group, and the condensation reaction was carried out using the double coupling method in which after all the reactions at 50° C. for 15 minutes, the solution was removed by filtration, and the same condensation reaction was repeated. After completion of solid-phase synthesis, the resin was washed with MeOH, and dried under reduced pressure to thereby obtain 470.7 mg of the protected peptide resin of interest, Ac-Tyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys(Eda-GGGGG-)Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Pro- Ser(tBu)-Ser(tBu)-Gly-Ala-Pro-Pro-Pro-Ser(tBu)-Sieber amide resin. To the total amount of the obtained resin, 4.8 mL of TFA:m-cresol:thioanisole:ethandithiol:H2O:triisopropylsilane (80:5:5:5:2.5:2.5) was added and the resulting mixture was stirred for 1.5 hours. Diethyl ether was added to the reaction solution to obtain a precipitate and after centrifugation the supernatant was removed. This operation was repeated twice and the precipitate was washed. The residue was extracted with a 90% acetic acid aqueous solution and the resin was removed by filtration, and then the purification was carried out by preparative HPLC using Phenomenex Kinetex 5 μm XB-C18 (250×30.0 mm I.D.) by the linear concentration gradient elution (60 minutes) with solution A: 0.1% TFA-water and solution B: 0.1% TFA-containing acetonitrile at a flow rate of 15 mL/minute from A/B: 57/43 to 47/53, and fractions containing the product of interest were collected and freeze-dried to thereby obtain 58.8 mg of a white powder.

Subsequently, the total amount of the obtained powder was dissolved in 50% acetonitrile-water, an ion exchange resin [AG1X8 resin (acetate form), 1.2 meq/mL, 152 μL] was added to the solution, and the resulting mixture was shaken for 1 hour. After removal of the resin by filtration, the filtrate was freeze-dried to thereby obtain 53.6 mg of the acetate of the product of interest.

Mass spectrometry result: (M+H)+4841.26 (calculated 4840.53)

HPLC elution time: 7.12 minutes

Elution Conditions:

Column: Kinetex 1.7 μm C8 100A, (100×2.1 mm I.D.)

Eluents: Using solution A: 0.1% TFA-water, solution B: 0.1% TFA-containing acetonitrile, A/B: 80/20 to 30/70. Linear concentration gradient elution (10 minutes).

Flow rate: 0.5 mL/minutes

Temperature: 40° C.

Example 16

Synthesis of H-MeTyr-Aib-Glu-Gly-Thr-Iva-Ile-Ser-Asp-Tyr-Ser-Ile-Aib-Lys(Oda-GGGGG-)-Asp-Arg-Aib-Ala-Gln-Aib-Asn-Phe-Val-Asn-Trp-Iva-Leu-Ala-Gln-Arg-NH$_2$ (SEQ ID NO: 428) (Compound 415)

Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Sieber amide resin (SEQ ID NO: 482) (38.1 mg, 0.005 mmol) synthesized in Reference Example B was weighed into a reaction tube, which was then set in a peptide synthesizer. Gly, Gly, Fmoc-Gly-Gly-Gly-OH, and octadecanedioic acid were introduced according to the protocol using 20% piperidine/NMP [reacted at 50° C. for 5 minutes] to deprotect the Fmoc group and 5 equivalents of Fmoc-amino acids/DIPCDI/Oxyma [reacted at 50° C. for 15 minutes] to condense the Fmoc-amino acids. In this case, 20% piperidine/NMP was used [reacted at 50° C. for 5 minutes] to deprotect the Fmoc group, and the condensation reaction was carried out using the double coupling method in which after the reactions at 50° C. for 15 minutes, the solution was removed by filtration, and the same condensation reaction was repeated. After completion of solid-phase synthesis, the resin was washed with MeOH, and dried under reduced pressure to thereby obtain 45.3 mg of the protected peptide resin of interest, Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys(Oda-GGGGG-)Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Sieber amide resin. To the total amount of the obtained resin, 0.5 mL of TFA:m-cresol:thioanisole:ethandithiol:H$_2$O:triisopropylsilane (80:5:5:5:2.5:2.5) was added and the resulting mixture was stirred for 1.5 hours. Diethyl ether was added to the reaction solution to obtain a precipitate and after centrifugation the supernatant was removed. This operation was repeated and the precipitate was washed. The residue was extracted with a 90% acetic acid aqueous solution and the resin was removed by filtration, and then the purification was carried out by preparative HPLC using Phenomenex Kinetex 5 μm XB-C18 (250×20.0 mm I.D.) by the linear concentration gradient elution (60 minutes) with solution A: 0.1% TFA-water and solution B: 0.1% TFA-containing acetonitrile at a flow rate of 8 mL/minute from A/B: 59/41 to 49/51, and fractions containing the product of interest were collected and freeze-dried to thereby obtain 3.7 mg of a white powder.

Mass spectrometry result: (M+H)+4006.32 (calculated 4007.14)

HPLC elution time: 5.97 minutes

Elution Conditions:

Column: Kinetex 1.7 μm C8 100A, (100×2.1 mm I.D.)

Eluents: Using solution A: 0.1% TFA-water, solution B: 0.1% TFA-containing acetonitrile, A/B: 80/20 to 30/70. Linear concentration gradient elution (10 minutes).

Flow rate: 0.5 mL/minutes

Temperature: 40° C.

Example 17

Synthesis of H-MeTyr-Aib-Glu-Gly-Thr-Iva-Ile-Ser-Asp-Tyr-Ser-Ile-Aib-Lys(Oda-GGGGG-)-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-OH (SEQ ID NO: 454) (Compound 441)

Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)- Gly-Ala-Pro-Pro-Pro-Ser(tBu)-Alko resin (SEQ ID NO: 483) (166.0 mg, 0.025 mmol) synthesized in Reference Example C was weighed into a reaction tube, which was then set in a peptide synthesizer. 20% piperidine/NMP [reacted at 50° C. for 5 minutes] was used to deprotect the Fmoc group, subsequently Fmoc-Gly-Gly-Gly-OH was introduced using the peptide synthesizer, and then Gly, Gly, and octadecanedioic acid were sequentially introduced. In this case, 20% piperidine/NMP was used [reacted at 50° C. for 5 minutes] to deprotect the Fmoc group, and the condensation reaction was carried out using the double coupling method was used in which after the reactions at 50° C. for 15 minutes, the solution was removed by filtration, and the same condensation reaction was repeated. After completion of solid-phase synthesis, the resin was washed with MeOH, and dried under reduced pressure to thereby obtain the protected peptide resin of interest, Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys(Oda-GGGGG-)-Asp(OtBu)-Arg(Pbf)-Aib-Ala-Gln(Trt)-Aib-Asn(Trt)-Phe-Val-Asn(Trt)-Trp(Boc)-Iva-Leu-Ala-Gln(Trt)-Arg(Pbf)- Pro-Ser(tBu)-Ser(tBu)-Gly-Ala-Pro-Pro-Pro-Ser(tBu)-Alko resin. Subsequently, to the total amount of the obtained resin, 2.5 mL of TFA:m-cresol:thioanisole:ethandithiol:H$_2$O:triisopropylsilane (80:5:5:5:2.5:2.5) was added and the resulting mixture was stirred for 1.5 hours. Diethyl ether was added to the reaction solution to obtain a precipitate and after centrifugation the supernatant was removed. This operation was repeated twice and the precipitate was washed. The residue was extracted with a 50% acetic acid aqueous solution and the resin was removed by filtration, and then the purification was carried out by preparative HPLC using YMC-Triart C8-S-10 μm, 20 nm column (250×30 mm I.D.) by the linear concentration gradient elution (60 minutes) with solution A: 0.1% TFA-water and solution B: 0.1% TFA-containing acetonitrile at a flow rate of 15 mL/minute from A/B: 40/60 to 50/50, and fractions containing the product of interest were collected and freeze-dried to thereby obtain 3.4 mg of a white powder.

Mass spectrometry result: (M+H)+4784.51 (calculated 4785.49)
HPLC elution time: 5.88 minutes
Elution Conditions:
Column: Kinetex 1.7 μm C8 100A, (100×2.1 mm I.D.)
Eluents: Using solution A: 0.1% TFA-water, solution B: 0.1% TFA-containing acetonitrile, A/B: 80/20 to 30/70. Linear concentration gradient elution (10 minutes).
Flow rate: 0.5 mL/minutes
Temperature: 40° C.

Example 18

Synthesis of H-MeTyr-Aib-Glu-Gly-Thr-Iva-Ile-Ser-Asp-Tyr-Ser-Ile-Aib-Leu-Asp-Arg-Lys(Eda-PEG(3)-PEG(3)-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH2 (SEQ ID NO: 320) (Compound 307)

Sieber amide resin (0.71 meq/g, 70.4 mg, 0.05 mmol) was added to a reaction tube, which was then set in a peptide synthesizer, and amino acids were sequentially extended according to the protocol using 20% piperidine/NMP [reacted at 50° C. for 5 minutes] to deprotect the Fmoc group and 5 equivalents of Fmoc-amino acids/DIPCDI/Oxyma [reacted at 50° C. for 15 minutes] to condense the Fmoc-amino acids. The operation wherein the obtained Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Leu-Asp(OtBu)-Arg(Pbf)-Lys(ivDde)-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Sieber amide resin was suspended in a 2% hydrazine/NMP solution, the resulting suspension was stirred at room temperature for 3 hours, and then the solution was removed by filtration. After the filtration, the resin was suspended in a 2% hydrazine/NMP solution and reacted at room temperature overnight to deprotect the ivDde group of Lys at position 14. Subsequently, the resin was washed with MeOH, and dried under reduced pressure to thereby obtain 388.8 mg of Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Leu-Asp(OtBu)-Arg(Pbf)-Lys-Ala-Gln(Trt)-Aib-Asn(Trt)-Phe-Val-Asn(Trt)-Trp(Boc)-Iva-Leu-Ala-Gln(Trt)-Arg(Pbf)-Pro-    Ser(tBu)-Ser(tBu)-Gly-Ala-Pro-Pro-Pro-Ser(tBu)-Sieber amide resin.

38.9 mg (0.01 mmol) of the obtained resin was weighed into a reaction tube, which was then set in a peptide synthesizer. According to the protocol using 20% piperidine/NMP [reacted at 50° C. for 5 minutes] to deprotect the Fmoc group, and using 5 equivalents of acid agent (Fmoc-amino acids or eicosanedioic acid mono-tert-butyl ester) and DIPCDI/Oxyma to condense, PEG(3), PEG(3), eicosanedioic acid mono-tert-butyl ester were sequentially introduced using the peptide synthesizer. The condensation reaction was carried out using the double coupling method was used in which after the reactions at 50° C. for 15 minutes, the solution was removed by filtration, and the same condensation reaction was repeated. After completion of solid-phase synthesis, the resin was washed with MeOH, and dried under reduced pressure to thereby obtain 39.3 mg of the protected peptide resin of interest, Boc-MeTyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Leu-Asp(OtBu)-Arg(Pbf)-Lys(19-tert-butoxycarbonyl-nonadedanoyl-PEG(3)-PEG(3)-)-Ala-Gln(Trt)-Aib-Asn(Trt)-Phe-Val-Asn(Trt)-Trp(Boc)-Iva-Leu-Ala-Gln(Trt)-Arg(Pbf)-Pro-Ser(tBu)-Ser(tBu)-Gly-Ala-Pro-Pro-Pro-Ser(tBu)-Sieber amide resin.

Subsequently, to the total amount of the obtained resin, 0.5 mL of TFA:m-cresol:thioanisole:ethandithiol:H$_2$O:triisopropylsilane (80:5:5:5:2.5:2.5) was added and the resulting mixture was stirred for 1.5 hours. Diethyl ether was added to the reaction solution to obtain a precipitate and after centrifugation the supernatant was removed. This operation was repeated twice and the precipitate was washed. The residue was extracted with a 90% acetic acid aqueous solution and the resin was removed by filtration, and then the purification was carried out by preparative HPLC using YMC-Triart C8-S-10 μm, 20 nm column (250× 20 mm I.D.) by the linear concentration gradient elution (60 minutes) with solution A: 0.1% TFA-water and solution B: 0.1% TFA-containing acetonitrile at a flow rate of 8 mL/minute from A/B: 52/48 to 4$^2/_5$8, and fractions containing the product of interest were collected and freeze-dried to thereby obtain 7.5 mg of a white powder.

Mass spectrometry result: (M+H)+ 4846.10 (calculated 4845.61)
HPLC elution time: 7.11 minutes
Elution Conditions:
Column: Kinetex 1.7 μm C8 100A, (100×2.1 mm I.D.)
Eluents: Using solution A: 0.1% TFA-water, solution B: 0.1% TFA-containing acetonitrile, A/B: 80/20 to 30/70. Linear concentration gradient elution (10 minutes).
Flow rate: 0.5 mL/minutes
Temperature: 40° C.

Example 19

Synthesis of Me-Tyr-Aib-Glu-Gly-Thr-Iva-Ile-Ser-Asp-Tyr-Ser-Ile-Aib-Lys(Hda-GGGGG-)-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$ (SEQ ID NO: 472) (Compound 459)

Sieber amide resin (0.71 meq/g, 352 mg, 0.25 mmol) was added to a reaction tube, which was then set in a peptide synthesizer, and amino acids were sequentially extended according to the protocol using 20% piperidine/NMP [reacted at room temperature for 15 minutes] to deprotect the Fmoc group and 5 equivalents of Fmoc-amino acids/DIPCDI/Oxyma [reacted at room temperature for 150 minutes] to condense the Fmoc-amino acids.

The operation wherein the obtained Boc-Me-Tyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys(ivDde)-Asp(OtBu)-Arg(Pbf)-Aib-Ala-Gln(Trt)-Aib-Asn(Trt)-Phe-Val-Asn(Trt)-Trp(Boc)-Iva-Leu- Ala-Gln(Trt)-Arg(Pbf)-Pro-Ser(tBu)-Ser(tBu)-Gly-Ala-Pro-Pro-Pro-Ser(tBu)-Sieber amide resin was suspended in a 2% hydrazine/NMP solution, the resulting suspension was stirred at room temperature for 3 hours, and then the solution was removed by filtration was repeated twice to deprotect the ivDde group of Lys at position 14.

Subsequently, the resin was washed with MeOH, and dried under reduced pressure to thereby obtain 1.87 g of Boc-Me-Tyr(tBu)-Aib-Glu(OtBu)-Gly-Thr(tBu)-Iva-Ile-Ser (tBu)-Asp(OtBu)-Tyr(tBu)-Ser(tBu)-Ile-Aib-Lys-Asp (OtBu)-Arg(Pbf)-Aib-Ala-Gln(Trt)-Aib-Asn(Trt)-Phe-Val-Asn(Trt)- Trp(Boc)-Iva-Leu-Ala-Gln(Trt)-Arg(Pbf)-Pro-Ser (tBu)-Ser(tBu)-Gly-Ala-Pro-Pro-Pro-Ser(tBu)-Sieber amide resin. 37.3 mg (0.005 mmol) of the obtained resin was weighed into a reaction tube, which was then set in a peptide synthesizer. Subsequently, Fmoc-Gly-Gly-OH and Fmoc-Gly-Gly-Gly-OH was introduced using the peptide synthesizer, according to the protcol using 20% piperidine/NMP [reacted at 50° C. for 5 minutes] to deprotect the Fmoc group and 5 equivalents of Fmoc-amino acids/DIPCDI/Oxyma [50° C., 15 minutes] to condense the Fmoc-amino acids, and then Boc-Me-Tyr(tBu)-Aib-Glu(OtBu)-Gly-Thr(tBu)-Iva-Ile-Ser(tBu)-Asp(OtBu)-Tyr(tBu)-Ser(tBu)-Ile-Aib-Lys(H-Gly-Gly-Gly-Gly-Gly-)-Asp(OtBu)-Arg(Pbf)-Aib-Ala-Gln (Trt)-Aib-Asn(Trt)-Phe-Val-Asn(Trt)-Trp(Boc)-Iva-Leu-Ala-Gln(Trt)- Arg(Pbf)-Pro-Ser(tBu)-Ser(tBu)-Gly-Ala-Pro-Pro-Pro-Ser(tBu)-Sieber amide resin was obtained. In this case, the condensation reaction was carried out using the double coupling method in which after all the reactions at 50° C. for 15 minutes, the solution was removed by filtration, and the same condensation reaction was repeated. To the obtained resine, 6.4 mg of adipic anhydride, 6.4 mg of DIPEA, and NMP (0.1 ml) were added, and then the solution was stirred at room temperature for 2 hours. After removal of the reaction solution by filtration, the resin was washed with MeOH, and dried under reduced pressure to thereby obtain 36.9 mg of the protected peptide resin of interest, Boc-Me-Tyr(tBu)-Aib-Glu(OtBu)-Gly-Thr(tBu)-Iva-Ile-Ser (tBu)-Asp(OtBu)-Tyr(tBu)-Ser(tBu)-Ile-Aib-Lys(Hda-GGGGG-)-Asp(tBu)-Arg(Pbf)-Aib-Ala-Gln(Trt)-Aib-Asn (Trt)-Phe-Val-Asn(Trt)-Trp(Boc)-Iva- Leu-Ala-Gln(Trt)-Arg(Pbf)-Pro-Ser(tBu)-Ser(tBu)-Gly-Ala-Pro-Pro-Pro-Ser (tBu)-Sieber amide resin.

Subsequently, to the total amount of the obtained resin, 0.5 mL of TFA:m-cresol:thioanisole:ethandithiol:$H_2O$:triisopropylsilane (80:5:5:5:2.5:2.5) was added and the resulting mixture was stirred for 1.5 hours. Diethyl ether was added to the reaction solution to obtain a precipitate and after centrifugation the supernatant was removed. This operation was repeated twice and the precipitate was washed. The residue was extracted with a 90% acetic acid aqueous solution and the resin was removed by filtration, and then the purification was carried out by preparative HPLC using Phenomenex Kinetex 5µm XB-C18 (250×20.0 mm I.D.) by the linear concentration gradient elution (60 minutes) with solution A: 0.1% TFA-water and solution B: 0.1% TFA-containing acetonitrile at a flow rate of 8 mL/minute from A/B: 66/34 to 56/44, and fractions containing the product of interest were collected and freeze-dried to thereby obtain 2.9 mg of a white powder. Mass spectrometry result: (M+H)+4616.573 (calculated 4616.32) HPLC elution time: 4.09 minutes
Elution conditions:
Column: Kinetex 1.7 µm C8 100A, (100×2.1 mm I.D.)
Eluents: Using solution A: 0.1% TFA-water, solution B: 0.1% TFA-containing acetonitrile, A/B: 80/20 to 30/70.
Linear concentration gradient elution (10 minutes).
Flow rate: 0.5 mL/minutes
Temperature: 40° C.

The compounds not described in Examples disclosed in FIGS. 8A-D and FIGS. 9A, 9B, 9C to 9M, 9N, 9O were synthesized in accordance with Examples 1 to 19.

Test Example 1

(A) Evaluation of Agonist Activity on Human GIPR and Human GLP-1R with Increase in Intracellular cAMP Concentration as Indicator
(1) Construction of Expression Plasmid of Human GIPR Gene
The human GIPR gene having an identical sequence to Genebank Accession No. U39231 was cloned into a pMSRα-neo vector to prepare hGIPR/pMSRα-neo.
(2) Construction of Reporter Plasmid Expressing Cell
Luciferase reporter gene with a cAMP-responsive sequence located upstream was transferred to a CHO-K1 cell to construct a CRE-LUC/CHO-K1 cell.
(3) Construction of Reporter Plasmid
4 Copies of a cAMP responsive sequence and a Zeocin resistance gene were transferred to pGL3(R2.2)-Basic Vector (Promega) to construct a Cre-luc(Zeo) reporter plasmid.
(4) Transfer of Human GIPR Gene to CRE-LUC/CHO-K1 Cell and Obtaining of Expressing Cell
The plasmid hGIPR/pMSRα-neo obtained in (1) was transferred to the CRE-LUC/CHO-K1 cell obtained in (2) to obtain a transformant. Subsequently, the cell line inducing the luciferase expression, hGIPR/CRE-LUC/CHO-K1 cell, was selected from the obtained transformant by adding GIP.
(5) Construction of Expression Plasmid of Human GLP-1R Gene
The human GLP-1R gene having an identical sequence to Genebank Accession No. NM_002062 was cloned into a pIRESneo3 vector to prepare hGLP-1/pIRESneo3.
(6) Transfer of Human GLP-1R Gene and Reporter Plasmid to CHO-K1 Cell and Obtaining of Expressing Cell
The Cre-luc (Zeo) obtained in (3) and the plasmid hGLP-1/pIRESneo3 obtained in (5) were transferred to the CHO-K1 cell to obtain a transformant. Subsequently, the cell line inducing the luciferase expression, hGLP-1R/CRE-luc/CHO-K1 cell, was selected from the obtained transformant by adding GLP-1.
(7) Reporter Assay
25 µL each of the hGIPR/CRE-LUC/CHO-K1 cell was inoculated in a 384-well white plate (Corning) in such a way as to provide 5×$10^3$ cells/well and cultured in a HamF12 medium containing 10% fetal bovine serum, 100 U/mL penicillin, and 100 µg/mL streptomycin in a CO2 incubator at 37° C. overnight. 5 µL of a medium containing a test compound was added to the cells and incubated for 4 hours at the indicated concentration in a $CO_2$ incubator at 37° C. Steady-Glo (Promega) was added in amounts of 30 µL and shaken under light shielding. 20 Minutes later, luciferase activity was measured using a plate reader Envision (PerkinElmer). The GIPR agonist activity was calculated with increase in intracellular cAMP concentration as the indicator when the luciferase activity in the presence of 10 nM of GIP was 100% and the luciferase activity in the case of adding DMSO instead of the test compound was 0%.

The GLP-1R agonist activity was assayed in the same manner as above using the hGLP-1R/CRE-luc/CHO-K1 cell. The GLP-1R agonist activity was calculated with increase in intracellular cAMP concentration as the indicator when the luciferase activity in the presence of 10 nM of GLP-1 was 100% and the luciferase activity in the case of adding DMSO instead of the test compound was 0%.

As shown in Table 2-1, the compounds of the present invention have an excellent GIP receptor selective activation action.

TABLE 2-1

| Compound # | Agonist activity (EC$_{50}$, M) GLP-1R | GIPR | SEQ ID NO. |
|---|---|---|---|
| 1 | 1.6E−07 | 3.7E−12 | SEQ ID NO. 7 |
| 2 | 3.5E−07 | 7.2E−13 | SEQ ID NO. 8 |
| 3 | 1.4E−07 | 4.5E−12 | SEQ ID NO. 9 |
| 4 | 4.3E−07 | 1.4E−12 | SEQ ID NO. 10 |
| 5 | >1.0E−06 | 3.9E−12 | SEQ ID NO. 11 |
| 6 | >1.0E−06 | 6.8E−12 | SEQ ID NO. 12 |
| 7 | >1.0E−06 | 2.1E−11 | SEQ ID NO. 13 |
| 8 | >1.0E−06 | 7.9E−11 | SEQ ID NO. 14 |
| 9 | >1.0E−06 | 1.0E−09 | SEQ ID NO. 15 |
| 10 | >1.0E−06 | 1.6E−11 | SEQ ID NO. 16 |
| 11 | 2.7E−08 | 1.1E−11 | SEQ ID NO. 17 |
| 12 | 2.0E−07 | 1.1E−10 | SEQ ID NO. 18 |
| 13 | 4.7E−08 | 7.4E−12 | SEQ ID NO. 19 |
| 14 | >1.0E−06 | 2.2E−11 | SEQ ID NO. 20 |
| 15 | >1.0E−06 | 1.7E−10 | SEQ ID NO. 21 |
| 16 | 5.3E−07 | 5.0E−10 | SEQ ID NO. 22 |
| 17 | >1.0E−06 | 3.1E−09 | SEQ ID NO. 23 |
| 18 | >1.0E−06 | 1.3E−09 | SEQ ID NO. 24 |
| 19 | >1.0E−06 | 2.7E−10 | SEQ ID NO. 25 |
| 20 | 1.9E−07 | 2.6E−10 | SEQ ID NO. 26 |
| 21 | >1.0E−06 | 1.8E−09 | SEQ ID NO. 27 |
| 22 | >1.0E−06 | 1.5E−09 | SEQ ID NO. 28 |
| 23 | >1.0E−06 | 5.9E−10 | SEQ ID NO. 29 |
| 24 | >1.0E−06 | 5.1E−09 | SEQ ID NO. 30 |
| 25 | >1.0E−06 | 1.4E−09 | SEQ ID NO. 31 |
| 26 | >1.0E−06 | 1.2E−08 | SEQ ID NO. 32 |
| 27 | >1.0E−06 | 4.1E−11 | SEQ ID NO. 33 |
| 28 | >1.0E−06 | 3.4E−11 | SEQ ID NO. 34 |
| 29 | >1.0E−06 | 3.3E−11 | SEQ ID NO. 35 |
| 30 | >1.0E−06 | 1.0E−11 | SEQ ID NO. 36 |
| 31 | >1.0E−06 | 8.0E−12 | SEQ ID NO. 37 |
| 32 | >1.0E−06 | 5.8E−12 | SEQ ID NO. 38 |
| 33 | >1.0E−06 | 6.9E−12 | SEQ ID NO. 39 |
| 34 | >1.0E−06 | 1.9E−11 | SEQ ID NO. 40 |
| 35 | >1.0E−06 | 2.4E−11 | SEQ ID NO. 41 |
| 36 | >1.0E−06 | 1.3E−11 | SEQ ID NO. 42 |
| 37 | >1.0E−06 | 1.3E−11 | SEQ ID NO. 43 |
| 38 | >1.0E−06 | 8.0E−12 | SEQ ID NO. 44 |
| 39 | >1.0E−06 | 1.4E−11 | SEQ ID NO. 45 |
| 40 | >1.0E−06 | 7.9E−12 | SEQ ID NO. 46 |
| 41 | >1.0E−06 | 4.8E−12 | SEQ ID NO. 47 |
| 42 | >1.0E−06 | 6.9E−12 | SEQ ID NO. 48 |
| 43 | 4.0E−07 | 6.3E−13 | SEQ ID NO. 49 |
| 44 | >1.0E−06 | 2.4E−12 | SEQ ID NO. 50 |
| 45 | >1.0E−06 | 8.1E−12 | SEQ ID NO. 51 |
| 46 | >1.0E−06 | 3.8E−11 | SEQ ID NO. 52 |
| 47 | >1.0E−06 | 1.1E−11 | SEQ ID NO. 53 |
| 48 | >1.0E−06 | 1.2E−11 | SEQ ID NO. 54 |
| 49 | >1.0E−06 | 4.5E−12 | SEQ ID NO. 55 |
| 50 | >1.0E−06 | 2.9E−12 | SEQ ID NO. 56 |
| 51 | >1.0E−06 | 5.8E−12 | SEQ ID NO. 57 |
| 52 | >1.0E−06 | 4.7E−12 | SEQ ID NO. 58 |
| 53 | >1.0E−06 | 8.7E−13 | SEQ ID NO. 59 |
| 54 | >1.0E−06 | 6.5E−12 | SEQ ID NO. 60 |
| 55 | >1.0E−06 | 5.3E−12 | SEQ ID NO. 61 |
| 56 | >1.0E−06 | 6.4E−12 | SEQ ID NO. 62 |
| 57 | >1.0E−06 | 2.0E−11 | SEQ ID NO. 63 |
| 58 | >1.0E−06 | 1.1E−11 | SEQ ID NO. 64 |
| 59 | >1.0E−06 | 9.4E−13 | SEQ ID NO. 65 |
| 60 | >1.0E−06 | 1.1E−12 | SEQ ID NO. 66 |
| 61 | >1.0E−06 | 1.1E−12 | SEQ ID NO. 67 |
| 62 | >1.0E−06 | 9.9E−13 | SEQ ID NO. 68 |
| 63 | >1.0E−06 | 1.2E−12 | SEQ ID NO. 69 |
| 64 | >1.0E−06 | 9.3E−13 | SEQ ID NO. 70 |
| 65 | >1.0E−06 | 1.6E−12 | SEQ ID NO. 71 |
| 66 | 3.2E−07 | 1.3E−12 | SEQ ID NO. 72 |
| 67 | >1.0E−06 | 1.4E−12 | SEQ ID NO. 73 |
| 68 | 3.5E−07 | 1.7E−12 | SEQ ID NO. 74 |
| 69 | >1.0E−06 | 1.7E−12 | SEQ ID NO. 75 |
| 70 | 7.1E−07 | 1.4E−12 | SEQ ID NO. 76 |
| 71 | >1.0E−06 | 2.5E−12 | SEQ ID NO. 77 |
| 72 | 2.3E−07 | 2.6E−12 | SEQ ID NO. 78 |
| 73 | >1.0E−06 | 1.4E−12 | SEQ ID NO. 79 |
| 74 | >1.0E−06 | 1.4E−12 | SEQ ID NO. 80 |
| 75 | >1.0E−06 | 1.4E−12 | SEQ ID NO. 81 |
| 76 | >1.0E−06 | 1.5E−12 | SEQ ID NO. 82 |
| 77 | >1.0E−06 | 8.3E−13 | SEQ ID NO. 83 |
| 78 | >1.0E−06 | 1.3E−12 | SEQ ID NO. 84 |
| 79 | >1.0E−06 | 1.1E−12 | SEQ ID NO. 85 |
| 80 | >1.0E−06 | 1.2E−12 | SEQ ID NO. 86 |
| 81 | >1.0E−06 | 1.5E−12 | SEQ ID NO. 87 |
| 82 | 1.0E−07 | 1.4E−12 | SEQ ID NO. 88 |
| 83 | 1.7E−07 | 1.7E−12 | SEQ ID NO. 89 |
| 84 | >1.0E−06 | 1.2E−12 | SEQ ID NO. 90 |
| 85 | >1.0E−06 | 1.1E−12 | SEQ ID NO. 91 |
| 86 | >1.0E−06 | 1.3E−12 | SEQ ID NO. 92 |
| 87 | >1.0E−06 | 1.3E−12 | SEQ ID NO. 93 |
| 88 | >1.0E−06 | 9.5E−13 | SEQ ID NO. 94 |
| 89 | >1.0E−06 | 9.4E−13 | SEQ ID NO. 95 |
| 90 | >1.0E−06 | 1.2E−12 | SEQ ID NO. 96 |
| 91 | >1.0E−06 | 8.5E−13 | SEQ ID NO. 97 |
| 92 | >1.0E−06 | 1.3E−12 | SEQ ID NO. 98 |
| 93 | >1.0E−06 | 1.0E−12 | SEQ ID NO. 99 |
| 94 | >1.0E−06 | 9.4E−13 | SEQ ID NO. 100 |
| 95 | >1.0E−06 | 9.0E−13 | SEQ ID NO. 101 |
| 96 | >1.0E−06 | 8.9E−13 | SEQ ID NO. 102 |
| 97 | >1.0E−06 | 1.7E−12 | SEQ ID NO. 103 |
| 98 | >1.0E−06 | 1.4E−12 | SEQ ID NO. 104 |
| 99 | >1.0E−06 | 2.9E−12 | SEQ ID NO. 105 |
| 100 | >1.0E−06 | 1.4E−12 | SEQ ID NO. 106 |
| 101 | >1.0E−06 | 8.3E−13 | SEQ ID NO. 107 |
| 102 | >1.0E−06 | 1.2E−12 | SEQ ID NO. 108 |
| 103 | >1.0E−06 | 1.3E−12 | SEQ ID NO. 109 |
| 104 | >1.0E−06 | 1.4E−12 | SEQ ID NO. 110 |
| 105 | >1.0E−06 | 9.3E−13 | SEQ ID NO. 111 |
| 106 | >1.0E−06 | 1.7E−12 | SEQ ID NO. 112 |
| 107 | >1.0E−06 | 1.4E−12 | SEQ ID NO. 113 |
| 108 | >1.0E−06 | 2.7E−12 | SEQ ID NO. 114 |
| 109 | >1.0E−06 | 1.1E−12 | SEQ ID NO. 115 |
| 110 | >1.0E−06 | 1.4E−12 | SEQ ID NO. 116 |
| 111 | >1.0E−06 | 1.7E−12 | SEQ ID NO. 117 |
| 112 | >1.0E−06 | 1.2E−12 | SEQ ID NO. 118 |
| 113 | >1.0E−06 | 1.2E−12 | SEQ ID NO. 119 |
| 114 | >1.0E−06 | 1.0E−12 | SEQ ID NO. 120 |
| 115 | >1.0E−06 | 1.1E−12 | SEQ ID NO. 121 |
| 116 | 2.0E−07 | 1.4E−12 | SEQ ID NO. 122 |
| 117 | >1.0E−06 | 1.7E−12 | SEQ ID NO. 123 |
| 118 | >1.0E−06 | 1.4E−12 | SEQ ID NO. 124 |
| 119 | >1.0E−06 | 3.9E−12 | SEQ ID NO. 125 |
| 120 | >1.0E−06 | 3.3E−12 | SEQ ID NO. 126 |
| 121 | 4.3E−07 | 1.1E−12 | SEQ ID NO. 127 |
| 122 | >1.0E−06 | 1.5E−12 | SEQ ID NO. 128 |
| 123 | >1.0E−06 | 1.3E−12 | SEQ ID NO. 129 |
| 124 | >1.0E−06 | 1.7E−12 | SEQ ID NO. 130 |
| 125 | >1.0E−06 | 1.8E−12 | SEQ ID NO. 131 |
| 126 | >1.0E−06 | 2.1E−12 | SEQ ID NO. 132 |
| 127 | >1.0E−06 | 2.4E−12 | SEQ ID NO. 133 |
| 128 | >1.0E−06 | 1.5E−12 | SEQ ID NO. 134 |
| 129 | >1.0E−06 | 1.7E−12 | SEQ ID NO. 135 |
| 130 | >1.0E−06 | 1.2E−12 | SEQ ID NO. 136 |
| 131 | >1.0E−06 | 1.9E−12 | SEQ ID NO. 137 |
| 132 | >1.0E−06 | 1.3E−12 | SEQ ID NO. 138 |
| 133 | >1.0E−06 | 1.7E−12 | SEQ ID NO. 139 |
| 134 | >1.0E−06 | 2.3E−12 | SEQ ID NO. 140 |
| 135 | >1.0E−06 | 1.8E−12 | SEQ ID NO. 141 |
| 136 | 2.1E−07 | 2.2E−12 | SEQ ID NO. 142 |
| 137 | >1.0E−06 | 1.7E−12 | SEQ ID NO. 143 |
| 138 | >1.0E−06 | 2.2E−12 | SEQ ID NO. 144 |
| 139 | >1.0E−06 | 2.5E−12 | SEQ ID NO. 145 |
| 140 | >1.0E−06 | 1.9E−12 | SEQ ID NO. 146 |
| 141 | >1.0E−06 | 1.9E−12 | SEQ ID NO. 147 |
| 142 | >1.0E−06 | 2.3E−12 | SEQ ID NO. 148 |
| 143 | >1.0E−06 | 2.9E−12 | SEQ ID NO. 149 |
| 144 | >1.0E−06 | 2.2E−12 | SEQ ID NO. 150 |
| 145 | >1.0E−06 | 1.9E−12 | SEQ ID NO. 151 |

TABLE 2-1-continued

| Compound # | Agonist activity ($EC_{50}$, M) GLP-1R | GIPR | SEQ ID NO. |
|---|---|---|---|
| 146 | >1.0E−06 | 1.9E−12 | SEQ ID NO. 152 |
| 147 | >1.0E−06 | 1.5E−12 | SEQ ID NO. 153 |
| 148 | >1.0E−06 | 1.3E−12 | SEQ ID NO. 154 |
| 149 | >1.0E−06 | 1.8E−12 | SEQ ID NO. 155 |
| 150 | >1.0E−06 | 1.8E−12 | SEQ ID NO. 156 |
| 151 | >1.0E−06 | 1.5E−12 | SEQ ID NO. 157 |
| 152 | >1.0E−06 | 2.8E−12 | SEQ ID NO. 158 |
| 153 | >1.0E−06 | 1.4E−12 | SEQ ID NO. 159 |
| 154 | >1.0E−06 | 1.1E−12 | SEQ ID NO. 160 |
| 155 | >1.0E−06 | 1.7E−12 | SEQ ID NO. 161 |
| 156 | >1.0E−06 | 4.8E−12 | SEQ ID NO. 162 |
| 157 | >1.0E−06 | 2.5E−12 | SEQ ID NO. 163 |
| 158 | >1.0E−06 | 9.9E−11 | SEQ ID NO. 171 |
| 159 | >1.0E−06 | 7.8E−10 | SEQ ID NO. 172 |
| 160 | >1.0E−06 | 9.5E−11 | SEQ ID NO. 173 |
| 161 | >1.0E−06 | 3.5E−09 | SEQ ID NO. 174 |
| 162 | >1.0E−06 | 2.7E−10 | SEQ ID NO. 175 |
| 163 | >1.0E−06 | 6.6E−09 | SEQ ID NO. 176 |
| 164 | >1.0E−06 | 1.2E−09 | SEQ ID NO. 177 |
| 165 | >1.0E−06 | 1.2E−09 | SEQ ID NO. 178 |
| 166 | >1.0E−06 | 3.5E−11 | SEQ ID NO. 179 |
| 167 | >1.0E−06 | 1.5E−10 | SEQ ID NO. 180 |
| 168 | >1.0E−06 | 3.9E−10 | SEQ ID NO. 181 |
| 169 | >1.0E−06 | 1.4E−09 | SEQ ID NO. 182 |
| 170 | >1.0E−06 | 2.0E−11 | SEQ ID NO. 183 |
| 171 | >1.0E−06 | 2.4E−10 | SEQ ID NO. 184 |
| 172 | >1.0E−06 | 2.0E−12 | SEQ ID NO. 185 |
| 173 | >1.0E−06 | 4.4E−12 | SEQ ID NO. 186 |
| 174 | >1.0E−06 | 4.2E−12 | SEQ ID NO. 187 |
| 175 | >1.0E−06 | 3.5E−12 | SEQ ID NO. 188 |
| 176 | >1.0E−06 | 1.9E−11 | SEQ ID NO. 189 |
| 177 | >1.0E−06 | 7.2E−12 | SEQ ID NO. 190 |
| 178 | >1.0E−06 | 4.2E−12 | SEQ ID NO. 191 |
| 179 | >1.0E−06 | 3.0E−12 | SEQ ID NO. 192 |
| 180 | >1.0E−06 | 1.9E−12 | SEQ ID NO. 193 |
| 181 | >1.0E−06 | 9.2E−12 | SEQ ID NO. 194 |
| 182 | 4.8E−08 | 3.3E−12 | SEQ ID NO. 195 |
| 183 | 3.3E−08 | 3.4E−12 | SEQ ID NO. 196 |
| 184 | 3.0E−08 | 3.6E−12 | SEQ ID NO. 197 |
| 185 | 2.6E−08 | 7.0E−12 | SEQ ID NO. 198 |
| 186 | 1.3E−08 | 6.4E−12 | SEQ ID NO. 199 |
| 187 | 1.1E−08 | 1.2E−11 | SEQ ID NO. 200 |
| 188 | 2.0E−07 | 3.0E−12 | SEQ ID NO. 201 |
| 189 | 2.7E−08 | 6.8E−12 | SEQ ID NO. 202 |
| 190 | >1.0E−06 | 2.1E−11 | SEQ ID NO. 203 |
| 191 | 5.0E−08 | 4.1E−12 | SEQ ID NO. 204 |
| 192 | 1.5E−08 | 6.5E−12 | SEQ ID NO. 205 |
| 193 | 7.7E−08 | 3.6E−12 | SEQ ID NO. 206 |
| 194 | 2.5E−08 | 3.5E−12 | SEQ ID NO. 207 |
| 195 | 1.0E−07 | 4.8E−12 | SEQ ID NO. 208 |
| 196 | 4.4E−08 | 6.3E−12 | SEQ ID NO. 209 |
| 197 | 1.1E−08 | 5.6E−12 | SEQ ID NO. 210 |
| 198 | 2.8E−08 | 4.5E−12 | SEQ ID NO. 211 |
| 199 | >1.0E−06 | 3.4E−11 | SEQ ID NO. 212 |
| 200 | 2.0E−08 | 5.1E−12 | SEQ ID NO. 213 |
| 201 | 1.1E−07 | 8.3E−12 | SEQ ID NO. 214 |
| 202 | 1.8E−07 | 4.6E−12 | SEQ ID NO. 215 |
| 203 | >1.0E−06 | 4.3E−12 | SEQ ID NO. 216 |
| 204 | 9.5E−09 | 8.1E−12 | SEQ ID NO. 217 |
| 205 | 2.9E−08 | 3.4E−12 | SEQ ID NO. 218 |
| 206 | >1.0E−06 | 2.1E−11 | SEQ ID NO. 219 |
| 207 | 3.0E−08 | 1.1E−11 | SEQ ID NO. 220 |
| 208 | >1.0E−06 | 6.1E−12 | SEQ ID NO. 221 |
| 209 | >1.0E−06 | 4.3E−12 | SEQ ID NO. 222 |
| 210 | >1.0E−06 | 3.2E−12 | SEQ ID NO. 223 |
| 211 | 2.6E−08 | 3.4E−12 | SEQ ID NO. 224 |
| 212 | 1.4E−07 | 4.7E−12 | SEQ ID NO. 225 |
| 213 | 5.4E−08 | 3.1E−12 | SEQ ID NO. 226 |
| 214 | 1.3E−08 | 4.2E−12 | SEQ ID NO. 227 |
| 215 | 1.5E−07 | 2.8E−12 | SEQ ID NO. 228 |
| 216 | 1.5E−07 | 4.8E−12 | SEQ ID NO. 229 |
| 217 | >1.0E−06 | 3.5E−12 | SEQ ID NO. 230 |
| 218 | 1.3E−07 | 7.6E−12 | SEQ ID NO. 231 |
| 219 | 1.6E−07 | 2.7E−12 | SEQ ID NO. 232 |
| 220 | 9.9E−08 | 5.3E−12 | SEQ ID NO. 233 |
| 221 | >1.0E−06 | 7.1E−12 | SEQ ID NO. 234 |
| 222 | >1.0E−06 | 3.7E−12 | SEQ ID NO. 235 |
| 223 | >1.0E−06 | 5.1E−12 | SEQ ID NO. 236 |
| 224 | >1.0E−06 | 4.2E−12 | SEQ ID NO. 237 |
| 226 | 1.2E−08 | 3.0E−12 | SEQ ID NO. 239 |
| 227 | 2.8E−09 | 3.4E−12 | SEQ ID NO. 240 |
| 228 | >1.0E−06 | 2.3E−11 | SEQ ID NO. 241 |
| 229 | 3.8E−08 | 4.8E−12 | SEQ ID NO. 242 |
| 230 | 1.1E−08 | 3.9E−12 | SEQ ID NO. 243 |
| 231 | >1.0E−06 | 2.2E−11 | SEQ ID NO. 244 |
| 232 | >1.0E−06 | 3.2E−12 | SEQ ID NO. 245 |
| 233 | >1.0E−06 | 3.8E−12 | SEQ ID NO. 246 |
| 234 | >1.0E−06 | 1.5E−10 | SEQ ID NO. 247 |
| 235 | >1.0E−06 | 2.8E−11 | SEQ ID NO. 248 |
| 236 | >1.0E−06 | 4.1E−11 | SEQ ID NO. 249 |
| 237 | >1.0E−06 | 1.6E−10 | SEQ ID NO. 250 |
| 238 | >1.0E−06 | 8.3E−11 | SEQ ID NO. 251 |
| 239 | 5.0E−08 | 2.5E−12 | SEQ ID NO. 252 |
| 240 | 5.8E−09 | 3.0E−12 | SEQ ID NO. 253 |
| 241 | >1.0E−06 | 3.4E−11 | SEQ ID NO. 254 |
| 242 | >1.0E−06 | 6.7E−11 | SEQ ID NO. 255 |
| 243 | >1.0E−06 | 1.7E−12 | SEQ ID NO. 256 |
| 244 | 2.2E−07 | 2.1E−10 | SEQ ID NO. 257 |
| 245 | >1.0E−06 | 2.2E−10 | SEQ ID NO. 258 |
| 246 | >1.0E−06 | 4.4E−10 | SEQ ID NO. 259 |
| 247 | >1.0E−06 | 1.2E−10 | SEQ ID NO. 260 |
| 248 | >1.0E−06 | 2.0E−10 | SEQ ID NO. 261 |
| 249 | >1.0E−06 | 3.0E−10 | SEQ ID NO. 262 |
| 250 | >1.0E−06 | 7.2E−11 | SEQ ID NO. 263 |
| 251 | 1.4E−08 | 4.4E−11 | SEQ ID NO. 264 |
| 252 | >1.0E−06 | 7.5E−11 | SEQ ID NO. 265 |
| 253 | >1.0E−06 | 3.0E−11 | SEQ ID NO. 266 |
| 254 | 3.1E−09 | 3.0E−11 | SEQ ID NO. 267 |
| 255 | >1.0E−06 | 4.4E−11 | SEQ ID NO. 268 |
| 256 | >1.0E−06 | 3.1E−10 | SEQ ID NO. 269 |
| 257 | >1.0E−06 | 9.0E−11 | SEQ ID NO. 270 |
| 258 | >1.0E−06 | 9.2E−11 | SEQ ID NO. 271 |
| 259 | >1.0E−06 | 1.2E−10 | SEQ ID NO. 272 |
| 260 | >1.0E−06 | 2.6E−10 | SEQ ID NO. 273 |
| 261 | >1.0E−06 | 5.5E−11 | SEQ ID NO. 274 |
| 262 | 2.7E−07 | 5.6E−11 | SEQ ID NO. 275 |
| 263 | >1.0E−06 | 7.6E−11 | SEQ ID NO. 276 |
| 264 | 3.0E−07 | 1.0E−10 | SEQ ID NO. 277 |
| 265 | >1.0E−06 | 3.1E−11 | SEQ ID NO. 278 |
| 266 | >1.0E−06 | 3.8E−11 | SEQ ID NO. 279 |
| 280 | >1.0E−06 | 1.6E−10 | SEQ ID NO. 293 |
| 281 | >1.0E−06 | 1.6E−10 | SEQ ID NO. 294 |
| 282 | >1.0E−06 | 9.9E−11 | SEQ ID NO. 295 |
| 283 | >1.0E−06 | 5.7E−11 | SEQ ID NO. 296 |
| 284 | >1.0E−06 | 4.0E−11 | SEQ ID NO. 297 |
| 285 | >1.0E−06 | 5.0E−10 | SEQ ID NO. 298 |
| 286 | >1.0E−06 | 1.0E−09 | SEQ ID NO. 299 |
| 287 | >1.0E−06 | 3.4E−10 | SEQ ID NO. 300 |
| 288 | >1.0E−06 | 1.7E−10 | SEQ ID NO. 301 |
| 289 | >1.0E−06 | 4.0E−11 | SEQ ID NO. 302 |
| 290 | >1.0E−06 | 3.8E−11 | SEQ ID NO. 303 |
| 291 | >1.0E−06 | 3.2E−11 | SEQ ID NO. 304 |
| 292 | >1.0E−06 | 3.4E−11 | SEQ ID NO. 305 |
| 293 | >1.0E−06 | 1.0E−10 | SEQ ID NO. 306 |
| 294 | >1.0E−06 | 8.9E−11 | SEQ ID NO. 307 |
| 295 | >1.0E−06 | 5.6E−11 | SEQ ID NO. 308 |
| 296 | >1.0E−06 | 6.9E−11 | SEQ ID NO. 309 |
| 297 | >1.0E−06 | 7.1E−11 | SEQ ID NO. 310 |
| 298 | >1.0E−06 | 4.6E−11 | SEQ ID NO. 311 |
| 299 | >1.0E−06 | 3.7E−09 | SEQ ID NO. 312 |
| 300 | >1.0E−06 | 2.3E−08 | SEQ ID NO. 313 |
| 301 | >1.0E−06 | 3.9E−11 | SEQ ID NO. 314 |
| 302 | >1.0E−06 | 8.4E−11 | SEQ ID NO. 315 |
| 303 | >1.0E−06 | 1.1E−10 | SEQ ID NO. 316 |
| 304 | >1.0E−06 | 3.8E−11 | SEQ ID NO. 317 |
| 305 | >1.0E−06 | 2.5E−10 | SEQ ID NO. 318 |
| 306 | >1.0E−06 | 5.9E−11 | SEQ ID NO. 319 |
| 307 | >1.0E−06 | 4.0E−11 | SEQ ID NO. 320 |
| 308 | >1.0E−06 | 2.2E−11 | SEQ ID NO. 321 |
| 309 | >1.0E−06 | 1.8E−11 | SEQ ID NO. 322 |

TABLE 2-1-continued

| Compound # | Agonist activity ($EC_{50}$, M) | | SEQ ID NO. |
|---|---|---|---|
| | GLP-1R | GIPR | |
| 310 | >1.0E-06 | 2.6E-11 | SEQ ID NO. 323 |
| 311 | >1.0E-06 | 1.7E-10 | SEQ ID NO. 324 |
| 312 | >1.0E-06 | 7.6E-11 | SEQ ID NO. 325 |
| 313 | >1.0E-06 | 6.7E-11 | SEQ ID NO. 326 |
| 314 | >1.0E-06 | 5.3E-11 | SEQ ID NO. 327 |
| 315 | >1.0E-06 | 9.0E-11 | SEQ ID NO. 328 |
| 316 | >1.0E-06 | 3.8E-11 | SEQ ID NO. 329 |
| 317 | >1.0E-06 | 4.0E-11 | SEQ ID NO. 330 |
| 318 | >1.0E-06 | 5.2E-11 | SEQ ID NO. 331 |
| 319 | >1.0E-06 | 4.2E-11 | SEQ ID NO. 332 |
| 320 | >1.0E-06 | 4.3E-11 | SEQ ID NO. 333 |
| 321 | >1.0E-06 | 6.5E-11 | SEQ ID NO. 334 |
| 322 | >1.0E-06 | 3.5E-11 | SEQ ID NO. 335 |
| 323 | >1.0E-06 | 4.3E-10 | SEQ ID NO. 336 |
| 324 | >1.0E-06 | 2.6E-10 | SEQ ID NO. 337 |
| 325 | >1.0E-06 | 3.2E-10 | SEQ ID NO. 338 |
| 326 | >1.0E-06 | 1.9E-10 | SEQ ID NO. 339 |
| 327 | >1.0E-06 | 1.5E-10 | SEQ ID NO. 340 |
| 328 | >1.0E-06 | 6.2E-10 | SEQ ID NO. 341 |
| 329 | >1.0E-06 | 3.0E-10 | SEQ ID NO. 342 |
| 330 | >1.0E-06 | 1.6E-10 | SEQ ID NO. 343 |
| 331 | >1.0E-06 | 7.9E-11 | SEQ ID NO. 344 |
| 332 | >1.0E-06 | 3.5E-11 | SEQ ID NO. 345 |
| 333 | >1.0E-06 | 3.7E-11 | SEQ ID NO. 346 |
| 334 | >1.0E-06 | 6.7E-11 | SEQ ID NO. 347 |
| 335 | >1.0E-06 | 3.9E-11 | SEQ ID NO. 348 |
| 336 | >1.0E-06 | 6.3E-11 | SEQ ID NO. 349 |
| 337 | >1.0E-06 | 8.3E-11 | SEQ ID NO. 350 |
| 338 | >1.0E-06 | 5.6E-11 | SEQ ID NO. 351 |
| 339 | >1.0E-06 | 4.1E-11 | SEQ ID NO. 352 |
| 340 | >1.0E-06 | 5.7E-11 | SEQ ID NO. 353 |
| 341 | >1.0E-06 | 4.8E-11 | SEQ ID NO. 354 |
| 342 | >1.0E-06 | 4.5E-11 | SEQ ID NO. 355 |
| 343 | >1.0E-06 | 3.1E-11 | SEQ ID NO. 356 |
| 344 | >1.0E-06 | 2.9E-11 | SEQ ID NO. 357 |
| 345 | >1.0E-06 | 2.2E-11 | SEQ ID NO. 358 |
| 346 | >1.0E-06 | 1.8E-11 | SEQ ID NO. 359 |
| 347 | >1.0E-06 | 6.4E-11 | SEQ ID NO. 360 |
| 348 | >1.0E-06 | 1.5E-11 | SEQ ID NO. 361 |
| 349 | >1.0E-06 | 1.9E-11 | SEQ ID NO. 362 |
| 350 | >1.0E-06 | 1.6E-11 | SEQ ID NO. 363 |
| 351 | >1.0E-06 | 1.4E-11 | SEQ ID NO. 364 |
| 352 | >1.0E-06 | 4.2E-11 | SEQ ID NO. 365 |
| 353 | >1.0E-06 | 1.6E-10 | SEQ ID NO. 366 |
| 354 | >1.0E-06 | 4.5E-11 | SEQ ID NO. 367 |
| 355 | >1.0E-06 | 1.1E-10 | SEQ ID NO. 368 |
| 356 | >1.0E-06 | 5.3E-11 | SEQ ID NO. 369 |
| 357 | >1.0E-06 | 5.6E-11 | SEQ ID NO. 370 |
| 358 | >1.0E-06 | 4.0E-11 | SEQ ID NO. 371 |
| 359 | >1.0E-06 | 5.2E-11 | SEQ ID NO. 372 |
| 360 | >1.0E-06 | 8.7E-11 | SEQ ID NO. 373 |
| 361 | >1.0E-06 | 6.7E-11 | SEQ ID NO. 374 |
| 362 | >1.0E-06 | 3.4E-11 | SEQ ID NO. 375 |
| 363 | >1.0E-06 | 8.6E-11 | SEQ ID NO. 376 |
| 364 | >1.0E-06 | 6.4E-11 | SEQ ID NO. 377 |
| 365 | >1.0E-06 | 5.2E-11 | SEQ ID NO. 378 |
| 366 | >1.0E-06 | 3.8E-11 | SEQ ID NO. 379 |
| 367 | >1.0E-06 | 6.5E-11 | SEQ ID NO. 380 |
| 368 | >1.0E-06 | 6.0E-11 | SEQ ID NO. 381 |
| 369 | >1.0E-06 | 5.5E-11 | SEQ ID NO. 382 |
| 370 | >1.0E-06 | 5.6E-11 | SEQ ID NO. 383 |
| 371 | >1.0E-06 | 3.5E-11 | SEQ ID NO. 384 |
| 372 | >1.0E-06 | 7.0E-11 | SEQ ID NO. 385 |
| 373 | >1.0E-06 | 4.6E-11 | SEQ ID NO. 386 |
| 374 | >1.0E-06 | 5.4E-11 | SEQ ID NO. 387 |
| 375 | >1.0E-06 | 6.5E-11 | SEQ ID NO. 388 |
| 376 | >1.0E-06 | 5.0E-11 | SEQ ID NO. 389 |
| 377 | 6.2E-07 | 3.5E-11 | SEQ ID NO. 390 |
| 378 | >1.0E-06 | 4.8E-11 | SEQ ID NO. 391 |
| 379 | >1.0E-06 | 3.1E-11 | SEQ ID NO. 392 |
| 380 | >1.0E-06 | 5.1E-11 | SEQ ID NO. 393 |
| 381 | >1.0E-06 | 4.4E-11 | SEQ ID NO. 394 |
| 382 | >1.0E-06 | 1.0E-10 | SEQ ID NO. 395 |
| 383 | >1.0E-06 | 4.3E-11 | SEQ ID NO. 396 |
| 384 | >1.0E-06 | 5.7E-11 | SEQ ID NO. 397 |
| 385 | >1.0E-06 | 8.3E-11 | SEQ ID NO. 398 |
| 386 | >1.0E-06 | 7.5E-11 | SEQ ID NO. 399 |
| 387 | >1.0E-06 | 5.9E-11 | SEQ ID NO. 400 |
| 388 | >1.0E-06 | 9.0E-11 | SEQ ID NO. 401 |
| 389 | >1.0E-06 | 8.0E-11 | SEQ ID NO. 402 |
| 390 | >1.0E-06 | 6.4E-11 | SEQ ID NO. 403 |
| 391 | >1.0E-06 | 1.1E-10 | SEQ ID NO. 404 |
| 392 | >1.0E-06 | 1.6E-10 | SEQ ID NO. 405 |
| 393 | >1.0E-06 | 8.0E-11 | SEQ ID NO. 406 |
| 394 | >1.0E-06 | 6.1E-11 | SEQ ID NO. 407 |
| 395 | >1.0E-06 | 4.4E-11 | SEQ ID NO. 408 |
| 396 | >1.0E-06 | 3.8E-11 | SEQ ID NO. 409 |
| 397 | >1.0E-06 | 1.1E-10 | SEQ ID NO. 410 |
| 398 | >1.0E-06 | 2.4E-10 | SEQ ID NO. 411 |
| 399 | >1.0E-06 | 1.2E-10 | SEQ ID NO. 412 |
| 400 | >1.0E-06 | 8.2E-11 | SEQ ID NO. 413 |
| 401 | >1.0E-06 | 1.1E-10 | SEQ ID NO. 414 |
| 402 | >1.0E-06 | 7.8E-11 | SEQ ID NO. 415 |
| 403 | >1.0E-06 | 1.1E-10 | SEQ ID NO. 416 |
| 404 | >1.0E-06 | 1.1E-10 | SEQ ID NO. 417 |
| 405 | >1.0E-06 | 4.3E-10 | SEQ ID NO. 418 |
| 406 | >1.0E-06 | 3.2E-10 | SEQ ID NO. 419 |
| 407 | >1.0E-06 | 3.6E-10 | SEQ ID NO. 420 |
| 408 | >1.0E-06 | 4.8E-10 | SEQ ID NO. 421 |
| 409 | >1.0E-06 | 8.3E-11 | SEQ ID NO. 422 |
| 410 | >1.0E-06 | 1.0E-10 | SEQ ID NO. 423 |
| 411 | >1.0E-06 | 1.1E-10 | SEQ ID NO. 424 |
| 412 | >1.0E-06 | 7.1E-11 | SEQ ID NO. 425 |
| 413 | >1.0E-06 | 1.0E-10 | SEQ ID NO. 426 |
| 414 | >1.0E-06 | 2.2E-11 | SEQ ID NO. 427 |
| 415 | >1.0E-06 | 2.4E-11 | SEQ ID NO. 428 |
| 416 | >1.0E-06 | 3.7E-10 | SEQ ID NO. 429 |
| 417 | >1.0E-06 | 3.1E-10 | SEQ ID NO. 430 |
| 418 | >1.0E-06 | 6.1E-10 | SEQ ID NO. 431 |
| 419 | >1.0E-06 | 4.9E-10 | SEQ ID NO. 432 |
| 420 | >1.0E-06 | 7.0E-11 | SEQ ID NO. 433 |
| 421 | >1.0E-06 | 1.9E-11 | SEQ ID NO. 434 |
| 422 | >1.0E-06 | 1.9E-10 | SEQ ID NO. 435 |
| 423 | >1.0E-06 | 2.4E-10 | SEQ ID NO. 436 |
| 424 | >1.0E-06 | 1.1E-10 | SEQ ID NO. 437 |
| 425 | >1.0E-06 | 8.0E-11 | SEQ ID NO. 438 |
| 426 | >1.0E-06 | 8.6E-11 | SEQ ID NO. 439 |
| 427 | >1.0E-06 | 7.8E-11 | SEQ ID NO. 440 |
| 428 | >1.0E-06 | 2.3E-10 | SEQ ID NO. 441 |
| 429 | >1.0E-06 | 1.2E-10 | SEQ ID NO. 442 |
| 430 | >1.0E-06 | 5.9E-10 | SEQ ID NO. 443 |
| 431 | >1.0E-06 | 1.7E-10 | SEQ ID NO. 444 |
| 432 | >1.0E-06 | 5.9E-11 | SEQ ID NO. 445 |
| 433 | >1.0E-06 | 4.2E-11 | SEQ ID NO. 446 |
| 434 | >1.0E-06 | 3.9E-11 | SEQ ID NO. 447 |
| 435 | >1.0E-06 | 5.1E-11 | SEQ ID NO. 448 |
| 436 | >1.0E-06 | 5.3E-11 | SEQ ID NO. 449 |
| 437 | >1.0E-06 | 5.8E-11 | SEQ ID NO. 450 |
| 438 | >1.0E-06 | 6.6E-11 | SEQ ID NO. 451 |
| 439 | >1.0E-06 | 1.6E-11 | SEQ ID NO. 452 |
| 440 | >1.0E-06 | 4.7E-11 | SEQ ID NO. 453 |
| 441 | >1.0E-06 | 3.1E-11 | SEQ ID NO. 454 |
| 442 | >1.0E-06 | 8.3E-11 | SEQ ID NO. 455 |
| 443 | >1.0E-06 | 3.1E-11 | SEQ ID NO. 456 |
| 444 | >1.0E-06 | 5.1E-11 | SEQ ID NO. 457 |
| 445 | >1.0E-06 | 5.6E-12 | SEQ ID NO. 458 |
| 446 | >1.0E-06 | 2.8E-12 | SEQ ID NO. 459 |
| 447 | >1.0E-06 | 1.8E-12 | SEQ ID NO. 460 |
| 448 | >1.0E-06 | 1.9E-12 | SEQ ID NO. 461 |
| 449 | >1.0E-06 | 2.0E-12 | SEQ ID NO. 462 |
| 450 | >1.0E-06 | 1.9E-12 | SEQ ID NO. 463 |
| 451 | >1.0E-06 | 2.0E-12 | SEQ ID NO. 464 |
| 452 | >1.0E-06 | 2.3E-12 | SEQ ID NO. 465 |
| 453 | >1.0E-06 | 3.5E-12 | SEQ ID NO. 466 |
| 454 | >1.0E-06 | 3.4E-12 | SEQ ID NO. 467 |
| 455 | >1.0E-06 | 3.3E-12 | SEQ ID NO. 468 |
| 456 | >1.0E-06 | 4.9E-12 | SEQ ID NO. 469 |
| 457 | >1.0E-06 | 2.6E-12 | SEQ ID NO. 470 |
| 458 | >1.0E-06 | 1.4E-11 | SEQ ID NO. 471 |
| 459 | >1.0E-06 | 2.7E-12 | SEQ ID NO. 472 |

TABLE 2-1-continued

| Compound # | Agonist activity (EC$_{50}$, M) GLP-1R | GIPR | SEQ ID NO. |
|---|---|---|---|
| 460 | >1.0E−06 | 9.7E−13 | SEQ ID NO. 473 |
| 461 | >1.0E−06 | 1.1E−12 | SEQ ID NO. 474 |
| 462 | >1.0E−06 | 3.1E−12 | SEQ ID NO. 475 |
| 463 | >1.0E−06 | 6.6E−12 | SEQ ID NO. 476 |
| 464 | >1.0E−06 | 5.2E−12 | SEQ ID NO. 477 |
| 465 | >1.0E−06 | 5.6E−12 | SEQ ID NO. 478 |
| 466 | >1.0E−06 | 6.1E−12 | SEQ ID NO. 479 |
| 467 | >1.0E−06 | 2.0E−12 | SEQ ID NO. 480 |
| 471 | >1.00E−06 | 5.8E−11 | SEQ ID NO. 484 |
| 472 | >1.00E−06 | 3.8E−12 | SEQ ID NO. 485 |
| 473 | >1.00E−06 | 3.2E−11 | SEQ ID NO. 486 |
| 474 | >1.00E−06 | 2.0E−12 | SEQ ID NO. 487 |
| 475 | >1.00E−06 | 4.2E−11 | SEQ ID NO. 488 |
| 476 | >1.00E−06 | 3.2E−12 | SEQ ID NO. 489 |
| 477 | >1.00E−06 | 4.8E−12 | SEQ ID NO. 490 |
| 478 | >1.00E−06 | 4.5E−12 | SEQ ID NO. 491 |
| 479 | >1.00E−06 | 1.4E−11 | SEQ ID NO. 492 |
| 480 | >1.00E−06 | 1.6E−11 | SEQ ID NO. 493 |
| 481 | >1.00E−06 | 3.3E−11 | SEQ ID NO. 494 |
| 482 | >1.00E−06 | 3.9E−11 | SEQ ID NO. 495 |
| 483 | >1.00E−06 | 2.5E−11 | SEQ ID NO. 496 |
| 484 | >1.00E−06 | 2.6E−11 | SEQ ID NO. 497 |
| 485 | >1.00E−06 | 2.1E−11 | SEQ ID NO. 498 |
| 486 | >1.00E−06 | 2.5E−11 | SEQ ID NO. 499 |
| 487 | >1.00E−06 | 5.8E−11 | SEQ ID NO. 500 |
| 488 | >1.00E−06 | 1.7E−11 | SEQ ID NO. 501 |
| 489 | >1.00E−06 | 1.4E−11 | SEQ ID NO. 502 |
| 490 | >1.00E−06 | 3.5E−11 | SEQ ID NO. 503 |
| 491 | >1.00E−06 | 1.7E−11 | SEQ ID NO. 504 |
| 492 | >1.00E−06 | 1.8E−11 | SEQ ID NO. 505 |
| 493 | >1.00E−06 | 4.6E−11 | SEQ ID NO. 506 |
| 494 | >1.00E−06 | 4.4E−12 | SEQ ID NO. 507 |
| 495 | >1.00E−06 | 5.8E−12 | SEQ ID NO. 508 |
| 496 | >1.00E−06 | 1.3E−11 | SEQ ID NO. 509 |
| 497 | >1.00E−06 | 1.3E−11 | SEQ ID NO. 510 |
| 498 | >1.00E−06 | 7.3E−12 | SEQ ID NO. 511 |
| 499 | >1.00E−06 | 1.2E−11 | SEQ ID NO. 512 |
| 500 | >1.00E−06 | 5.9E−12 | SEQ ID NO. 513 |
| 501 | >1.00E−06 | 6.0E−12 | SEQ ID NO. 514 |
| 502 | >1.00E−06 | 8.4E−12 | SEQ ID NO. 515 |
| 503 | >1.00E−06 | 5.1E−12 | SEQ ID NO. 516 |
| 504 | >1.00E−06 | 8.9E−12 | SEQ ID NO. 517 |
| 505 | >1.00E−06 | 8.2E−12 | SEQ ID NO. 518 |
| 506 | >1.00E−06 | 1.2E−11 | SEQ ID NO. 519 |
| 507 | >1.00E−06 | 6.8E−12 | SEQ ID NO. 520 |
| 508 | >1.00E−06 | 1.8E−11 | SEQ ID NO. 521 |
| 509 | >1.00E−06 | 1.1E−11 | SEQ ID NO. 522 |
| 510 | >1.00E−06 | 1.8E−11 | SEQ ID NO. 523 |
| 511 | >1.00E−06 | 1.4E−11 | SEQ ID NO. 524 |
| 512 | >1.00E−06 | 1.7E−11 | SEQ ID NO. 525 |
| 513 | >1.00E−06 | 1.0E−11 | SEQ ID NO. 526 |
| 514 | >1.00E−06 | 2.4E−11 | SEQ ID NO. 527 |
| 515 | >1.00E−06 | 6.3E−12 | SEQ ID NO. 528 |
| 516 | >1.00E−06 | 6.3E−12 | SEQ ID NO. 529 |
| 517 | >1.00E−06 | 6.6E−12 | SEQ ID NO. 530 |
| 518 | >1.00E−06 | 8.1E−12 | SEQ ID NO. 531 |
| 519 | >1.00E−06 | 1.2E−11 | SEQ ID NO. 532 |
| 520 | >1.00E−06 | 5.6E−11 | SEQ ID NO. 533 |
| 521 | >1.00E−06 | 5.4E−11 | SEQ ID NO. 534 |
| 522 | >1.00E−06 | 1.2E−10 | SEQ ID NO. 535 |

(B) Evaluation of Binding Activity to Human GIPR Using [$^{125}$I]-GIP (1) Construction of Expression Plasmid of Human GIPR Gene The human GIPR gene having an identical sequence to Genebank Accession No. U39231 was cloned into a pcDNA3.3 vector to prepare hGIPR/pcDNA3.3.

(2) Preparation of Human GIPR Virus-like Particle (VLP) using Expi293F Cell

On the day before transfection, 850 mL of Expi293F cells were inoculated in a concentration of 1.8×10$^6$ cells/mL in a 3-L flask (Corning Incorporated) and cultured under conditions of 37° C., 8% CO$_2$, 85 rpm for 24 hours. The transfection was carried out using Expi293 Expression System Kit (Thermo Fisher Scientific). More specifically, 0.67 mg of pcDNA3.3/hGIPR and 0.33 mg of pcDNA3.3/GAG plasmid for VLP preparation were added to 50 mL of opti-MEM (Thermo Fisher Scientific) to prepare a DNA mixture. Subsequently, 2.7 mL of Expifectamine was added to 50 mL of opti-MEM and allowed to stand for 5 minutes, then the DNA mixture was mixed thereinto and the resulting mixture was allowed to stand for 20 minutes and then further added to the culture medium. 20 hours after transfection, 5 mL of Enhancers 1 and 50 mL of Enhancers 2 were added thereto. 96 hours after transfection, the culture medium was centrifuged at 850×g for 15 minutes to thereby obtain a supernatant. The obtained supernatant was ultra-centrifuged at 54000×g for 1 hour to thereby obtain a GIPR_VLP fraction. The precipitate was washed once with PBS and then suspended in a small amount of PBS to thereby obtain GIPR_VLP. The obtained GIPR_VLP was stored at −80° C. until used. Protein quantification was carried out using GelCode Blue Safe Protein Stain (Thermo Fisher Scientific) with BSA as the standard.

(3) Measurement of Binding Activity of Test Compounds to Human GIPR

For the measurement of the binding activity to GIPR, [$^{125}$I]GIP (PerkinElmer, Inc.) in a final concentration of 100 pM and a test compound in a specified concentration were mixed to GIPR_VLP in an assay buffer (50 mM HEPES (pH 7.4, WAKO 342-01375), 5 mM EGTA (WAKO 346-01312), 5 mM MgCl$_2$ (WAKO 136-03995), 0.1% BSA (Merckmillipore 81-066-04) and 0.005% Tween 20 (BioRad 170-6531)) and reacted at room temperature for 2 hours. VLP to which [$^{125}$I]GIP was bound was trapped in a GF/C glass fiber filter 96-well plate (PerkinElmer 6005274) using a cell harvester and washed with an assay buffer. The GF/C glass fiber filter 96-well plate in which VLP was trapped was dried at 42° C. overnight. Thereafter, MicroScint-O (PerkinElmer 6013611) was added to the GF/C glass fiber filter 96-well plate sealed using a backseal and the plate was sealed using a topseal. The radioactivity of each well was eventually measured using Topcount (PerkinElmer) and the binding activity of the test compound to GIPR was calculated when the [$^{125}$I]GIP binding activity in the presence of GIP in a final concentration of 1 μm was 100% and the [$^{125}$I]GIP binding activity of the wells to which DMSO was added was 0%.

As shown in Table 2-2, the compounds of the present invention have excellent binding activity to the GIP receptor.

TABLE 2-2

| compound # | Binding Activity (IC$_{50}$, M) GIPR | SEQ ID NO. |
|---|---|---|
| 1 | 8.8E−09 | SEQ ID NO. 7 |
| 2 | 1.4E−09 | SEQ ID NO. 8 |
| 3 | 6.0E−09 | SEQ ID NO. 9 |
| 4 | 1.5E−09 | SEQ ID NO. 10 |
| 5 | 2.6E−09 | SEQ ID NO. 11 |
| 6 | 2.5E−09 | SEQ ID NO. 12 |
| 7 | 5.9E−09 | SEQ ID NO. 13 |
| 8 | 1.7E−08 | SEQ ID NO. 14 |
| 9 | 1.1E−07 | SEQ ID NO. 15 |
| 10 | 5.8E−09 | SEQ ID NO. 16 |
| 11 | 1.7E−09 | SEQ ID NO. 17 |
| 12 | 9.4E−09 | SEQ ID NO. 18 |
| 13 | 2.5E−09 | SEQ ID NO. 19 |
| 14 | 7.0E−09 | SEQ ID NO. 20 |
| 15 | 7.0E−08 | SEQ ID NO. 21 |
| 16 | 1.3E−07 | SEQ ID NO. 22 |

TABLE 2-2-continued

| compound # | Binding Activity (IC$_{50}$, M) GIPR | SEQ ID NO. |
|---|---|---|
| 17 | 1.3E−07 | SEQ ID NO. 23 |
| 18 | 1.4E−07 | SEQ ID NO. 24 |
| 19 | 2.6E−07 | SEQ ID NO. 25 |
| 20 | 2.1E−07 | SEQ ID NO. 26 |
| 21 | 3.9E−07 | SEQ ID NO. 27 |
| 22 | 9.4E−08 | SEQ ID NO. 28 |
| 23 | 2.1E−07 | SEQ ID NO. 29 |
| 24 | 3.7E−07 | SEQ ID NO. 30 |
| 25 | 5.2E−07 | SEQ ID NO. 31 |
| 26 | 4.2E−07 | SEQ ID NO. 32 |
| 27 | 6.3E−08 | SEQ ID NO. 33 |
| 28 | 4.8E−08 | SEQ ID NO. 34 |
| 29 | 4.6E−08 | SEQ ID NO. 35 |
| 30 | 1.3E−09 | SEQ ID NO. 36 |
| 31 | 1.4E−09 | SEQ ID NO. 37 |
| 32 | 2.0E−09 | SEQ ID NO. 38 |
| 33 | 2.0E−09 | SEQ ID NO. 39 |
| 34 | 1.8E−09 | SEQ ID NO. 40 |
| 35 | 2.2E−09 | SEQ ID NO. 41 |
| 36 | 1.5E−09 | SEQ ID NO. 42 |
| 37 | 1.7E−09 | SEQ ID NO. 43 |
| 38 | 2.0E−09 | SEQ ID NO. 44 |
| 39 | 1.6E−09 | SEQ ID NO. 45 |
| 40 | 1.6E−09 | SEQ ID NO. 46 |
| 41 | 1.0E−09 | SEQ ID NO. 47 |
| 42 | 1.1E−09 | SEQ ID NO. 48 |
| 43 | 3.3E−09 | SEQ ID NO. 49 |
| 44 | 1.4E−09 | SEQ ID NO. 50 |
| 45 | 1.3E−08 | SEQ ID NO. 51 |
| 46 | 2.0E−07 | SEQ ID NO. 52 |
| 47 | 2.5E−08 | SEQ ID NO. 53 |
| 48 | 1.2E−08 | SEQ ID NO. 54 |
| 49 | 2.1E−08 | SEQ ID NO. 55 |
| 50 | 8.7E−09 | SEQ ID NO. 56 |
| 51 | 2.5E−08 | SEQ ID NO. 57 |
| 52 | 1.9E−09 | SEQ ID NO. 58 |
| 53 | 1.5E−09 | SEQ ID NO. 59 |
| 54 | 1.6E−09 | SEQ ID NO. 60 |
| 55 | 1.8E−09 | SEQ ID NO. 61 |
| 56 | 2.3E−09 | SEQ ID NO. 62 |
| 57 | 1.9E−09 | SEQ ID NO. 63 |
| 58 | 2.1E−09 | SEQ ID NO. 64 |
| 59 | 1.1E−09 | SEQ ID NO. 65 |
| 60 | 1.4E−09 | SEQ ID NO. 66 |
| 61 | 1.5E−09 | SEQ ID NO. 67 |
| 62 | 1.1E−09 | SEQ ID NO. 68 |
| 63 | 1.8E−09 | SEQ ID NO. 69 |
| 64 | 2.4E−09 | SEQ ID NO. 70 |
| 65 | 1.6E−09 | SEQ ID NO. 71 |
| 66 | 1.3E−09 | SEQ ID NO. 72 |
| 67 | 2.0E−09 | SEQ ID NO. 73 |
| 68 | 2.4E−09 | SEQ ID NO. 74 |
| 69 | 1.3E−09 | SEQ ID NO. 75 |
| 70 | 1.8E−09 | SEQ ID NO. 76 |
| 71 | 2.1E−09 | SEQ ID NO. 77 |
| 72 | 2.7E−09 | SEQ ID NO. 78 |
| 73 | 1.3E−09 | SEQ ID NO. 79 |
| 74 | 1.9E−09 | SEQ ID NO. 80 |
| 75 | 1.3E−09 | SEQ ID NO. 81 |
| 76 | 1.7E−09 | SEQ ID NO. 82 |
| 77 | 1.1E−09 | SEQ ID NO. 83 |
| 78 | 2.5E−09 | SEQ ID NO. 84 |
| 79 | 1.2E−09 | SEQ ID NO. 85 |
| 80 | 1.8E−09 | SEQ ID NO. 86 |
| 81 | 1.1E−09 | SEQ ID NO. 87 |
| 82 | 1.5E−09 | SEQ ID NO. 88 |
| 83 | 3.1E−09 | SEQ ID NO. 89 |
| 84 | 1.2E−09 | SEQ ID NO. 90 |
| 85 | 1.4E−09 | SEQ ID NO. 91 |
| 86 | 1.3E−09 | SEQ ID NO. 92 |
| 87 | 1.5E−09 | SEQ ID NO. 93 |
| 88 | 1.0E−09 | SEQ ID NO. 94 |
| 89 | 9.5E−10 | SEQ ID NO. 95 |
| 90 | 2.0E−09 | SEQ ID NO. 96 |
| 91 | 1.2E−09 | SEQ ID NO. 97 |
| 92 | 2.3E−09 | SEQ ID NO. 98 |
| 93 | 1.0E−09 | SEQ ID NO. 99 |
| 94 | 1.5E−09 | SEQ ID NO. 100 |
| 95 | 1.1E−09 | SEQ ID NO. 101 |
| 96 | 1.8E−09 | SEQ ID NO. 102 |
| 97 | 1.1E−09 | SEQ ID NO. 103 |
| 98 | 1.3E−09 | SEQ ID NO. 104 |
| 99 | 2.1E−09 | SEQ ID NO. 105 |
| 100 | 1.4E−09 | SEQ ID NO. 106 |
| 101 | 9.4E−10 | SEQ ID NO. 107 |
| 102 | 1.4E−09 | SEQ ID NO. 108 |
| 103 | 2.0E−09 | SEQ ID NO. 109 |
| 104 | 1.5E−09 | SEQ ID NO. 110 |
| 105 | 1.3E−09 | SEQ ID NO. 111 |
| 106 | 1.6E−09 | SEQ ID NO. 112 |
| 107 | 1.3E−09 | SEQ ID NO. 113 |
| 108 | 2.2E−09 | SEQ ID NO. 114 |
| 109 | 1.1E−09 | SEQ ID NO. 115 |
| 110 | 1.7E−09 | SEQ ID NO. 116 |
| 111 | 2.5E−09 | SEQ ID NO. 117 |
| 112 | 1.1E−09 | SEQ ID NO. 118 |
| 113 | 1.9E−09 | SEQ ID NO. 119 |
| 114 | 1.1E−09 | SEQ ID NO. 120 |
| 115 | 1.0E−09 | SEQ ID NO. 121 |
| 116 | 9.7E−10 | SEQ ID NO. 122 |
| 117 | 5.2E−09 | SEQ ID NO. 123 |
| 118 | 1.2E−09 | SEQ ID NO. 124 |
| 119 | 1.5E−09 | SEQ ID NO. 125 |
| 120 | 1.1E−09 | SEQ ID NO. 126 |
| 121 | 1.0E−09 | SEQ ID NO. 127 |
| 122 | 9.0E−10 | SEQ ID NO. 128 |
| 123 | 1.5E−09 | SEQ ID NO. 129 |
| 124 | 1.6E−09 | SEQ ID NO. 130 |
| 125 | 1.8E−09 | SEQ ID NO. 131 |
| 126 | 1.1E−09 | SEQ ID NO. 132 |
| 127 | 1.0E−09 | SEQ ID NO. 133 |
| 128 | 9.2E−10 | SEQ ID NO. 134 |
| 129 | 1.1E−09 | SEQ ID NO. 135 |
| 130 | 1.1E−09 | SEQ ID NO. 136 |
| 131 | 1.9E−09 | SEQ ID NO. 137 |
| 132 | 1.8E−09 | SEQ ID NO. 138 |
| 133 | 1.8E−09 | SEQ ID NO. 139 |
| 134 | 1.2E−09 | SEQ ID NO. 140 |
| 135 | 2.0E−09 | SEQ ID NO. 141 |
| 136 | 2.1E−09 | SEQ ID NO. 142 |
| 137 | 9.8E−10 | SEQ ID NO. 143 |
| 138 | 1.5E−09 | SEQ ID NO. 144 |
| 139 | 9.9E−10 | SEQ ID NO. 145 |
| 140 | 1.2E−09 | SEQ ID NO. 146 |
| 141 | 1.1E−09 | SEQ ID NO. 147 |
| 142 | 1.1E−09 | SEQ ID NO. 148 |
| 143 | 1.3E−09 | SEQ ID NO. 149 |
| 144 | 1.1E−09 | SEQ ID NO. 150 |
| 145 | 1.1E−09 | SEQ ID NO. 151 |
| 146 | 2.3E−09 | SEQ ID NO. 152 |
| 147 | 1.3E−09 | SEQ ID NO. 153 |
| 148 | 1.3E−09 | SEQ ID NO. 154 |
| 149 | 1.2E−09 | SEQ ID NO. 155 |
| 150 | 1.6E−09 | SEQ ID NO. 156 |
| 151 | 1.5E−09 | SEQ ID NO. 157 |
| 152 | 2.1E−09 | SEQ ID NO. 158 |
| 153 | 1.1E−09 | SEQ ID NO. 159 |
| 154 | 1.2E−09 | SEQ ID NO. 160 |
| 155 | 1.9E−09 | SEQ ID NO. 161 |
| 156 | 1.9E−09 | SEQ ID NO. 162 |
| 157 | 1.6E−09 | SEQ ID NO. 163 |
| 158 | 3.4E−09 | SEQ ID NO. 171 |
| 159 | 8.1E−09 | SEQ ID NO. 172 |
| 160 | 4.1E−09 | SEQ ID NO. 173 |
| 161 | 2.4E−08 | SEQ ID NO. 174 |
| 162 | 5.4E−09 | SEQ ID NO. 175 |
| 163 | 5.0E−08 | SEQ ID NO. 176 |
| 164 | 4.2E−09 | SEQ ID NO. 177 |
| 165 | 2.0E−08 | SEQ ID NO. 178 |
| 166 | 2.9E−09 | SEQ ID NO. 179 |
| 167 | 7.0E−09 | SEQ ID NO. 180 |
| 168 | 3.7E−09 | SEQ ID NO. 181 |
| 169 | 1.6E−08 | SEQ ID NO. 182 |
| 170 | 3.5E−09 | SEQ ID NO. 183 |

TABLE 2-2-continued

| compound # | Binding Activity (IC$_{50}$, M) GIPR | SEQ ID NO. |
|---|---|---|
| 171 | 3.2E-09 | SEQ ID NO. 184 |
| 172 | 3.1E-09 | SEQ ID NO. 185 |
| 173 | 7.1E-09 | SEQ ID NO. 186 |
| 174 | 3.8E-09 | SEQ ID NO. 187 |
| 175 | 2.0E-09 | SEQ ID NO. 188 |
| 176 | 3.4E-09 | SEQ ID NO. 189 |
| 177 | 2.4E-09 | SEQ ID NO. 190 |
| 178 | 3.0E-09 | SEQ ID NO. 191 |
| 179 | 2.1E-09 | SEQ ID NO. 192 |
| 180 | 1.2E-09 | SEQ ID NO. 193 |
| 181 | 2.6E-09 | SEQ ID NO. 194 |
| 182 | 1.3E-09 | SEQ ID NO. 195 |
| 183 | 2.0E-09 | SEQ ID NO. 196 |
| 184 | 2.1E-09 | SEQ ID NO. 197 |
| 185 | 1.9E-08 | SEQ ID NO. 198 |
| 186 | 1.8E-08 | SEQ ID NO. 199 |
| 187 | 1.1E-08 | SEQ ID NO. 200 |
| 188 | 2.7E-09 | SEQ ID NO. 201 |
| 189 | 1.3E-08 | SEQ ID NO. 202 |
| 190 | 5.8E-09 | SEQ ID NO. 203 |
| 191 | 2.7E-09 | SEQ ID NO. 204 |
| 192 | 2.5E-09 | SEQ ID NO. 205 |
| 193 | 2.5E-09 | SEQ ID NO. 206 |
| 194 | 2.3E-09 | SEQ ID NO. 207 |
| 195 | 2.3E-09 | SEQ ID NO. 208 |
| 196 | 2.4E-09 | SEQ ID NO. 209 |
| 197 | 2.6E-09 | SEQ ID NO. 210 |
| 198 | 1.8E-09 | SEQ ID NO. 211 |
| 199 | 2.4E-09 | SEQ ID NO. 212 |
| 200 | 2.0E-09 | SEQ ID NO. 213 |
| 201 | 1.6E-09 | SEQ ID NO. 214 |
| 202 | 1.7E-09 | SEQ ID NO. 215 |
| 203 | 2.1E-09 | SEQ ID NO. 216 |
| 204 | 2.6E-09 | SEQ ID NO. 217 |
| 205 | 1.6E-09 | SEQ ID NO. 218 |
| 206 | 2.2E-09 | SEQ ID NO. 219 |
| 207 | 1.8E-09 | SEQ ID NO. 220 |
| 208 | 1.3E-09 | SEQ ID NO. 221 |
| 209 | 1.9E-09 | SEQ ID NO. 222 |
| 210 | 1.1E-09 | SEQ ID NO. 223 |
| 211 | 3.5E-09 | SEQ ID NO. 224 |
| 212 | 3.5E-09 | SEQ ID NO. 225 |
| 213 | 3.1E-09 | SEQ ID NO. 226 |
| 214 | 3.3E-09 | SEQ ID NO. 227 |
| 215 | 2.8E-09 | SEQ ID NO. 228 |
| 216 | 3.5E-09 | SEQ ID NO. 229 |
| 217 | 2.5E-09 | SEQ ID NO. 230 |
| 218 | 2.9E-09 | SEQ ID NO. 231 |
| 219 | 2.8E-09 | SEQ ID NO. 232 |
| 220 | 2.9E-09 | SEQ ID NO. 233 |
| 221 | 3.0E-09 | SEQ ID NO. 234 |
| 222 | 2.9E-09 | SEQ ID NO. 235 |
| 223 | 3.0E-09 | SEQ ID NO. 236 |
| 224 | 2.5E-09 | SEQ ID NO. 237 |
| 226 | 2.8E-09 | SEQ ID NO. 239 |
| 227 | 3.1E-09 | SEQ ID NO. 240 |
| 228 | 6.1E-09 | SEQ ID NO. 241 |
| 229 | 2.6E-09 | SEQ ID NO. 242 |
| 230 | 2.6E-09 | SEQ ID NO. 243 |
| 231 | 8.8E-09 | SEQ ID NO. 244 |
| 232 | 2.1E-09 | SEQ ID NO. 245 |
| 233 | 2.2E-09 | SEQ ID NO. 246 |
| 234 | 8.2E-08 | SEQ ID NO. 247 |
| 235 | 1.8E-08 | SEQ ID NO. 248 |
| 236 | 1.2E-08 | SEQ ID NO. 249 |
| 237 | 1.1E-07 | SEQ ID NO. 250 |
| 238 | 4.3E-08 | SEQ ID NO. 251 |
| 239 | 2.2E-09 | SEQ ID NO. 252 |
| 240 | 2.4E-09 | SEQ ID NO. 253 |
| 241 | 1.3E-08 | SEQ ID NO. 254 |
| 242 | 1.8E-08 | SEQ ID NO. 255 |
| 243 | 1.7E-09 | SEQ ID NO. 256 |
| 244 | 1.0E-08 | SEQ ID NO. 257 |
| 245 | 1.3E-08 | SEQ ID NO. 258 |
| 246 | 7.2E-09 | SEQ ID NO. 259 |
| 247 | 5.9E-09 | SEQ ID NO. 260 |
| 248 | 1.5E-08 | SEQ ID NO. 261 |
| 249 | 6.4E-09 | SEQ ID NO. 262 |
| 250 | 6.9E-09 | SEQ ID NO. 263 |
| 251 | 3.2E-09 | SEQ ID NO. 264 |
| 252 | 1.4E-08 | SEQ ID NO. 265 |
| 253 | 7.0E-09 | SEQ ID NO. 266 |
| 254 | 2.7E-09 | SEQ ID NO. 267 |
| 255 | 1.1E-08 | SEQ ID NO. 268 |
| 256 | 1.4E-08 | SEQ ID NO. 269 |
| 257 | 1.5E-08 | SEQ ID NO. 270 |
| 258 | 1.5E-08 | SEQ ID NO. 271 |
| 259 | 2.2E-08 | SEQ ID NO. 272 |
| 260 | 1.5E-08 | SEQ ID NO. 273 |
| 261 | 1.7E-08 | SEQ ID NO. 274 |
| 262 | 8.6E-09 | SEQ ID NO. 275 |
| 263 | 2.0E-08 | SEQ ID NO. 276 |
| 264 | 4.8E-09 | SEQ ID NO. 277 |
| 265 | 1.0E-08 | SEQ ID NO. 278 |
| 266 | 1.0E-08 | SEQ ID NO. 279 |
| 280 | 4.0E-08 | SEQ ID NO. 293 |
| 281 | 3.3E-08 | SEQ ID NO. 294 |
| 282 | 1.9E-08 | SEQ ID NO. 295 |
| 283 | 7.8E-09 | SEQ ID NO. 296 |
| 284 | 6.5E-09 | SEQ ID NO. 297 |
| 285 | 8.6E-09 | SEQ ID NO. 298 |
| 286 | 1.5E-08 | SEQ ID NO. 299 |
| 287 | 1.5E-08 | SEQ ID NO. 300 |
| 288 | 3.6E-09 | SEQ ID NO. 301 |
| 289 | 5.8E-09 | SEQ ID NO. 302 |
| 290 | 6.6E-09 | SEQ ID NO. 303 |
| 291 | 7.4E-09 | SEQ ID NO. 304 |
| 292 | 7.3E-09 | SEQ ID NO. 305 |
| 293 | 9.4E-09 | SEQ ID NO. 306 |
| 294 | 1.1E-08 | SEQ ID NO. 307 |
| 295 | 6.2E-09 | SEQ ID NO. 308 |
| 296 | 6.5E-09 | SEQ ID NO. 309 |
| 297 | 1.5E-08 | SEQ ID NO. 310 |
| 298 | 7.1E-09 | SEQ ID NO. 311 |
| 299 | >1.00E-06 | SEQ ID NO. 312 |
| 300 | >1.00E-06 | SEQ ID NO. 313 |
| 301 | 9.4E-09 | SEQ ID NO. 314 |
| 302 | 4.0E-08 | SEQ ID NO. 315 |
| 303 | 6.7E-08 | SEQ ID NO. 316 |
| 304 | 2.5E-07 | SEQ ID NO. 317 |
| 305 | 7.6E-08 | SEQ ID NO. 318 |
| 306 | 7.1E-09 | SEQ ID NO. 319 |
| 307 | 5.0E-09 | SEQ ID NO. 320 |
| 308 | 4.2E-09 | SEQ ID NO. 321 |
| 309 | 4.0E-09 | SEQ ID NO. 322 |
| 310 | 3.5E-09 | SEQ ID NO. 323 |
| 311 | 1.2E-07 | SEQ ID NO. 324 |
| 312 | 5.4E-08 | SEQ ID NO. 325 |
| 313 | 5.7E-08 | SEQ ID NO. 326 |
| 314 | 4.8E-08 | SEQ ID NO. 327 |
| 315 | 1.0E-07 | SEQ ID NO. 328 |
| 316 | 4.5E-08 | SEQ ID NO. 329 |
| 317 | 5.8E-08 | SEQ ID NO. 330 |
| 318 | 8.3E-08 | SEQ ID NO. 331 |
| 319 | 1.0E-07 | SEQ ID NO. 332 |
| 320 | 6.9E-08 | SEQ ID NO. 333 |
| 321 | 5.1E-08 | SEQ ID NO. 334 |
| 322 | 4.0E-08 | SEQ ID NO. 335 |
| 323 | 1.1E-08 | SEQ ID NO. 336 |
| 324 | 7.8E-09 | SEQ ID NO. 337 |
| 325 | 1.6E-08 | SEQ ID NO. 338 |
| 326 | 1.5E-08 | SEQ ID NO. 339 |
| 327 | 1.3E-08 | SEQ ID NO. 340 |
| 328 | 2.8E-08 | SEQ ID NO. 341 |
| 329 | 2.5E-08 | SEQ ID NO. 342 |
| 330 | 1.1E-08 | SEQ ID NO. 343 |
| 331 | 1.5E-08 | SEQ ID NO. 344 |
| 332 | 8.3E-09 | SEQ ID NO. 345 |
| 333 | 7.3E-09 | SEQ ID NO. 346 |
| 334 | 1.5E-08 | SEQ ID NO. 347 |
| 335 | 7.2E-09 | SEQ ID NO. 348 |
| 336 | 1.3E-08 | SEQ ID NO. 349 |
| 337 | 1.7E-08 | SEQ ID NO. 350 |
| 338 | 1.4E-08 | SEQ ID NO. 351 |

TABLE 2-2-continued

| compound # | Binding Activity (IC$_{50}$, M) GIPR | SEQ ID NO. |
|---|---|---|
| 339 | 1.4E−08 | SEQ ID NO. 352 |
| 340 | 1.4E−08 | SEQ ID NO. 353 |
| 341 | 1.6E−08 | SEQ ID NO. 354 |
| 342 | 1.3E−08 | SEQ ID NO. 355 |
| 343 | 3.6E−09 | SEQ ID NO. 356 |
| 344 | 3.8E−09 | SEQ ID NO. 357 |
| 345 | 5.2E−09 | SEQ ID NO. 358 |
| 346 | 3.5E−09 | SEQ ID NO. 359 |
| 347 | 1.1E−08 | SEQ ID NO. 360 |
| 348 | 4.5E−08 | SEQ ID NO. 361 |
| 349 | 4.2E−09 | SEQ ID NO. 362 |
| 350 | 1.4E−08 | SEQ ID NO. 363 |
| 351 | 3.2E−09 | SEQ ID NO. 364 |
| 352 | 1.3E−08 | SEQ ID NO. 365 |
| 353 | 2.3E−08 | SEQ ID NO. 366 |
| 354 | 1.4E−08 | SEQ ID NO. 367 |
| 355 | 2.0E−08 | SEQ ID NO. 368 |
| 356 | 1.0E−08 | SEQ ID NO. 369 |
| 357 | 2.6E−08 | SEQ ID NO. 370 |
| 358 | 1.6E−08 | SEQ ID NO. 371 |
| 359 | 9.4E−09 | SEQ ID NO. 372 |
| 360 | 2.6E−08 | SEQ ID NO. 373 |
| 361 | 1.8E−08 | SEQ ID NO. 374 |
| 362 | 9.6E−09 | SEQ ID NO. 375 |
| 363 | 1.2E−08 | SEQ ID NO. 376 |
| 364 | 9.6E−09 | SEQ ID NO. 377 |
| 365 | 8.7E−09 | SEQ ID NO. 378 |
| 366 | 8.7E−09 | SEQ ID NO. 379 |
| 367 | 1.4E−08 | SEQ ID NO. 380 |
| 368 | 1.4E−08 | SEQ ID NO. 381 |
| 369 | 1.5E−08 | SEQ ID NO. 382 |
| 370 | 1.2E−08 | SEQ ID NO. 383 |
| 371 | 8.3E−09 | SEQ ID NO. 384 |
| 372 | 3.3E−09 | SEQ ID NO. 385 |
| 373 | 9.7E−09 | SEQ ID NO. 386 |
| 374 | 1.7E−08 | SEQ ID NO. 387 |
| 375 | 1.7E−08 | SEQ ID NO. 388 |
| 376 | 1.3E−08 | SEQ ID NO. 389 |
| 377 | 8.7E−09 | SEQ ID NO. 390 |
| 378 | 2.7E−08 | SEQ ID NO. 391 |
| 379 | 6.7E−09 | SEQ ID NO. 392 |
| 380 | 1.4E−08 | SEQ ID NO. 393 |
| 381 | 8.7E−09 | SEQ ID NO. 394 |
| 382 | 1.2E−08 | SEQ ID NO. 395 |
| 383 | 1.0E−08 | SEQ ID NO. 396 |
| 384 | 1.7E−08 | SEQ ID NO. 397 |
| 385 | 1.5E−08 | SEQ ID NO. 398 |
| 386 | 2.1E−08 | SEQ ID NO. 399 |
| 387 | 8.2E−09 | SEQ ID NO. 400 |
| 388 | 9.4E−09 | SEQ ID NO. 401 |
| 389 | 1.9E−08 | SEQ ID NO. 402 |
| 390 | 1.4E−08 | SEQ ID NO. 403 |
| 391 | 3.4E−08 | SEQ ID NO. 404 |
| 392 | 2.7E−08 | SEQ ID NO. 405 |
| 393 | 1.2E−08 | SEQ ID NO. 406 |
| 394 | 1.0E−08 | SEQ ID NO. 407 |
| 395 | 1.5E−08 | SEQ ID NO. 408 |
| 396 | 9.4E−09 | SEQ ID NO. 409 |
| 397 | 1.7E−08 | SEQ ID NO. 410 |
| 398 | 2.0E−08 | SEQ ID NO. 411 |
| 399 | 3.0E−08 | SEQ ID NO. 412 |
| 400 | 2.0E−08 | SEQ ID NO. 413 |
| 401 | 2.3E−08 | SEQ ID NO. 414 |
| 402 | 1.8E−08 | SEQ ID NO. 415 |
| 403 | 3.1E−08 | SEQ ID NO. 416 |
| 404 | 2.4E−08 | SEQ ID NO. 417 |
| 405 | 3.6E−08 | SEQ ID NO. 418 |
| 406 | 2.9E−08 | SEQ ID NO. 419 |
| 407 | 5.3E−08 | SEQ ID NO. 420 |
| 408 | 8.4E−08 | SEQ ID NO. 421 |
| 409 | 1.7E−08 | SEQ ID NO. 422 |
| 410 | 4.4E−08 | SEQ ID NO. 423 |
| 411 | 2.4E−08 | SEQ ID NO. 424 |
| 412 | 1.6E−08 | SEQ ID NO. 425 |
| 413 | 2.4E−08 | SEQ ID NO. 426 |
| 414 | 4.0E−09 | SEQ ID NO. 427 |
| 415 | 4.3E−09 | SEQ ID NO. 428 |
| 416 | 1.6E−07 | SEQ ID NO. 429 |
| 417 | 3.9E−07 | SEQ ID NO. 430 |
| 418 | 3.8E−07 | SEQ ID NO. 431 |
| 419 | 5.0E−07 | SEQ ID NO. 432 |
| 420 | 1.2E−08 | SEQ ID NO. 433 |
| 421 | 3.2E−09 | SEQ ID NO. 434 |
| 422 | 2.3E−08 | SEQ ID NO. 435 |
| 423 | 2.5E−07 | SEQ ID NO. 436 |
| 424 | 5.0E−08 | SEQ ID NO. 437 |
| 425 | 2.6E−08 | SEQ ID NO. 438 |
| 426 | 2.2E−08 | SEQ ID NO. 439 |
| 427 | 1.5E−08 | SEQ ID NO. 440 |
| 428 | 7.2E−08 | SEQ ID NO. 441 |
| 429 | 5.7E−08 | SEQ ID NO. 442 |
| 430 | 3.1E−07 | SEQ ID NO. 443 |
| 431 | 2.8E−08 | SEQ ID NO. 444 |
| 432 | 9.2E−09 | SEQ ID NO. 445 |
| 433 | 8.7E−09 | SEQ ID NO. 446 |
| 434 | 1.0E−08 | SEQ ID NO. 447 |
| 435 | 1.8E−08 | SEQ ID NO. 448 |
| 436 | 2.2E−08 | SEQ ID NO. 449 |
| 437 | 3.0E−08 | SEQ ID NO. 450 |
| 438 | 2.5E−08 | SEQ ID NO. 451 |
| 439 | 3.1E−09 | SEQ ID NO. 452 |
| 440 | 8.0E−09 | SEQ ID NO. 453 |
| 441 | 3.8E−09 | SEQ ID NO. 454 |
| 442 | 9.8E−09 | SEQ ID NO. 455 |
| 443 | 4.5E−09 | SEQ ID NO. 456 |
| 444 | 1.2E−08 | SEQ ID NO. 457 |
| 445 | 9.2E−10 | SEQ ID NO. 458 |
| 446 | 7.4E−10 | SEQ ID NO. 459 |
| 447 | 7.9E−10 | SEQ ID NO. 460 |
| 448 | 1.0E−09 | SEQ ID NO. 461 |
| 449 | 1.2E−09 | SEQ ID NO. 462 |
| 450 | 1.1E−09 | SEQ ID NO. 463 |
| 451 | 9.9E−10 | SEQ ID NO. 464 |
| 452 | 1.0E−09 | SEQ ID NO. 465 |
| 453 | 1.5E−09 | SEQ ID NO. 466 |
| 454 | 1.1E−09 | SEQ ID NO. 467 |
| 455 | 1.1E−09 | SEQ ID NO. 468 |
| 456 | 1.6E−09 | SEQ ID NO. 469 |
| 457 | 1.4E−09 | SEQ ID NO. 470 |
| 458 | 3.2E−09 | SEQ ID NO. 471 |
| 459 | 1.7E−09 | SEQ ID NO. 472 |
| 460 | 1.3E−09 | SEQ ID NO. 473 |
| 461 | 1.3E−09 | SEQ ID NO. 474 |
| 462 | 2.0E−09 | SEQ ID NO. 475 |
| 463 | 2.1E−09 | SEQ ID NO. 476 |
| 464 | 1.9E−09 | SEQ ID NO. 477 |
| 465 | 2.2E−09 | SEQ ID NO. 478 |
| 466 | 1.8E−09 | SEQ ID NO. 479 |
| 467 | 1.4E−09 | SEQ ID NO. 480 |
| 471 | 9.6E−09 | SEQ ID NO. 484 |
| 472 | 1.8E−09 | SEQ ID NO. 485 |
| 473 | 6.8E−09 | SEQ ID NO. 486 |
| 474 | 1.1E−09 | SEQ ID NO. 487 |
| 475 | 8.9E−09 | SEQ ID NO. 488 |
| 476 | 1.8E−09 | SEQ ID NO. 489 |
| 477 | 2.8E−09 | SEQ ID NO. 490 |
| 478 | 2.3E−09 | SEQ ID NO. 491 |
| 479 | 4.6E−09 | SEQ ID NO. 492 |
| 480 | 5.8E−09 | SEQ ID NO. 493 |
| 481 | 1.4E−08 | SEQ ID NO. 494 |
| 482 | 1.8E−08 | SEQ ID NO. 495 |
| 483 | 8.5E−09 | SEQ ID NO. 496 |
| 484 | 1.0E−08 | SEQ ID NO. 497 |
| 485 | 1.2E−08 | SEQ ID NO. 498 |
| 486 | 1.7E−08 | SEQ ID NO. 499 |
| 487 | 2.1E−08 | SEQ ID NO. 500 |
| 488 | 6.4E−09 | SEQ ID NO. 501 |
| 489 | 9.4E−09 | SEQ ID NO. 502 |
| 490 | 2.1E−08 | SEQ ID NO. 503 |
| 491 | 1.3E−08 | SEQ ID NO. 504 |
| 492 | 1.3E−08 | SEQ ID NO. 505 |
| 493 | 2.5E−08 | SEQ ID NO. 506 |
| 494 | 3.2E−09 | SEQ ID NO. 507 |
| 495 | 4.6E−09 | SEQ ID NO. 508 |

TABLE 2-2-continued

| compound # | Binding Activity (IC$_{50}$, M) GIPR | SEQ ID NO. |
|---|---|---|
| 496 | 1.0E−08 | SEQ ID NO. 509 |
| 497 | 8.4E−09 | SEQ ID NO. 510 |
| 498 | 7.7E−09 | SEQ ID NO. 511 |
| 499 | 9.6E−09 | SEQ ID NO. 512 |
| 500 | 6.6E−09 | SEQ ID NO. 513 |
| 501 | 6.3E−09 | SEQ ID NO. 514 |
| 502 | 1.4E−08 | SEQ ID NO. 515 |
| 503 | 8.0E−09 | SEQ ID NO. 516 |
| 504 | 9.1E−09 | SEQ ID NO. 517 |
| 505 | 4.0E−09 | SEQ ID NO. 518 |
| 506 | 5.3E−09 | SEQ ID NO. 519 |
| 507 | 5.4E−09 | SEQ ID NO. 520 |
| 508 | 9.1E−09 | SEQ ID NO. 521 |
| 509 | 7.3E−09 | SEQ ID NO. 522 |
| 510 | 1.2E−08 | SEQ ID NO. 523 |
| 511 | 8.3E−09 | SEQ ID NO. 524 |
| 512 | 1.3E−08 | SEQ ID NO. 525 |
| 513 | 8.4E−09 | SEQ ID NO. 526 |
| 514 | 1.2E−08 | SEQ ID NO. 527 |
| 515 | 5.7E−09 | SEQ ID NO. 528 |
| 516 | 4.1E−09 | SEQ ID NO. 529 |
| 517 | 8.7E−09 | SEQ ID NO. 530 |
| 518 | 5.8E−09 | SEQ ID NO. 531 |
| 519 | 1.4E−08 | SEQ ID NO. 532 |
| 520 | 1.8E−08 | SEQ ID NO. 533 |
| 521 | 2.0E−08 | SEQ ID NO. 534 |
| 522 | 2.8E−08 | SEQ ID NO. 535 |

Test Example 2

Oral Glucose Tolerance Test (1)

An oral glucose tolerance test (OGTT) was carried out using C57BL/6J mice with a glucose load of 0.03 nmol/kg. Each peptide or a solvent (control group) was subcutaneously administered 30 minutes before glucose loading and the glucose levels 30 minutes and 60 minutes after oral glucose administration were measured to evaluate the action of the compound. The action of the compound was calculated by the calculation formula below and expressed as the rate of increase in blood glucose level (%).

Rate of increase in blood glucose level (%)=(blood glucose level after glucose loading-blood glucose level before glucose loading of compound administered group)/(blood glucose level after glucose loading-blood glucose level before glucose loading of control group)×100

Results are shown in Table 3-1. As shown in Table 3-1, it is verified that the compounds of the present invention suppress increase in blood glucose level caused by oral glucose loading.

TABLE 3-1

| Compound # | Rate of increase in blood glucose level (%) | |
|---|---|---|
| | 30 min | 60 min |
| 4 | 83 | 55 |
| 6 | 56 | 31 |
| 13 | 61 | 35 |
| 30 | 96 | 85 |
| 41 | 55 | 31 |
| 42 | 70 | 43 |
| 52 | 74 | 42 |
| 54 | 85 | 92 |
| 59 | 41 | 23 |
| 60 | 40 | 34 |
| 61 | 58 | 31 |
| 62 | 59 | 22 |
| 63 | 54 | 25 |
| 64 | 45 | 20 |
| 65 | 38 | 36 |
| 66 | 51 | 32 |
| 67 | 42 | 16 |
| 68 | 42 | 11 |
| 69 | 47 | 23 |
| 71 | 52 | 27 |
| 72 | 46 | 17 |
| 73 | 44 | 29 |
| 74 | 46 | 34 |
| 75 | 45 | 16 |
| 76 | 52 | 37 |
| 77 | 98 | 92 |
| 78 | 40 | 16 |
| 79 | 51 | 32 |
| 81 | 56 | 29 |
| 82 | 41 | 16 |
| 83 | 48 | 25 |
| 84 | 44 | 16 |
| 85 | 46 | 29 |
| 86 | 48 | 27 |
| 87 | 40 | 21 |
| 88 | 45 | 30 |
| 89 | 52 | 26 |
| 90 | 40 | 17 |
| 91 | 56 | 31 |
| 92 | 44 | 17 |
| 93 | 43 | 31 |
| 94 | 45 | 22 |
| 95 | 49 | 23 |
| 96 | 40 | 16 |
| 97 | 47 | 30 |
| 98 | 94 | 85 |
| 99 | 91 | 73 |
| 100 | 89 | 52 |
| 101 | 88 | 66 |
| 102 | 34 | 16 |
| 103 | 35 | 15 |
| 104 | 31 | 8 |
| 105 | 50 | 19 |
| 106 | 42 | 13 |
| 107 | 36 | 8 |
| 108 | 42 | 9 |
| 109 | 53 | 34 |
| 110 | 42 | 23 |
| 111 | 52 | 21 |
| 113 | 48 | 11 |
| 114 | 43 | 17 |
| 117 | 51 | 16 |
| 125 | 35 | 14 |
| 129 | 59 | 31 |
| 130 | 50 | 33 |
| 131 | 56 | 31 |
| 132 | 62 | 34 |
| 133 | 46 | 24 |
| 134 | 53 | 22 |
| 135 | 54 | 39 |
| 136 | 59 | 31 |
| 137 | 53 | 31 |
| 138 | 45 | 18 |
| 139 | 46 | 17 |
| 140 | 54 | 56 |
| 141 | 65 | 50 |
| 142 | 44 | 20 |
| 143 | 64 | 66 |
| 144 | 63 | 48 |
| 145 | 52 | 58 |
| 146 | 45 | 23 |
| 147 | 43 | 23 |
| 150 | 57 | 40 |
| 151 | 62 | 35 |
| 152 | 65 | 37 |

TABLE 3-1-continued

| Compound # | Rate of increase in blood glucose level (%) | |
|---|---|---|
| | 30 min | 60 min |
| 153 | 69 | 39 |
| 154 | 48 | 34 |
| 155 | 62 | 29 |
| 156 | 66 | 55 |
| 157 | 61 | 50 |

Oral Glucose Tolerance Test (2)

An oral glucose tolerance test (OGTT) was carried out using C57BL/6J mice with a glucose load of 3 nmol/kg. Each peptide or a solvent (control group) was subcutaneously administered 72 hours before glucose loading and the blood glucose levels 30 minutes after oral glucose administration were measured to evaluate the action of the compound. The action of the compound was calculated by the calculation formula below and expressed as the rate of increase in blood glucose level (%).

Rate of increase in blood glucose level (%)=(blood glucose level after glucose loading-blood glucose level before glucose loading of compound administered group)/(blood glucose level after glucose loading-blood glucose level before glucose loading of control group)×100

Results are shown in Table 3-2. As shown in Table 3-2, it is verified that the compounds of the present invention suppress increase in blood glucose level caused by oral glucose loading.

TABLE 3-2

| compound # | Rate of increase in blood glucose level (%) 72 hr |
|---|---|
| 341 | 47 |
| 349 | 69 |

Test Example 3

Figure 1B:
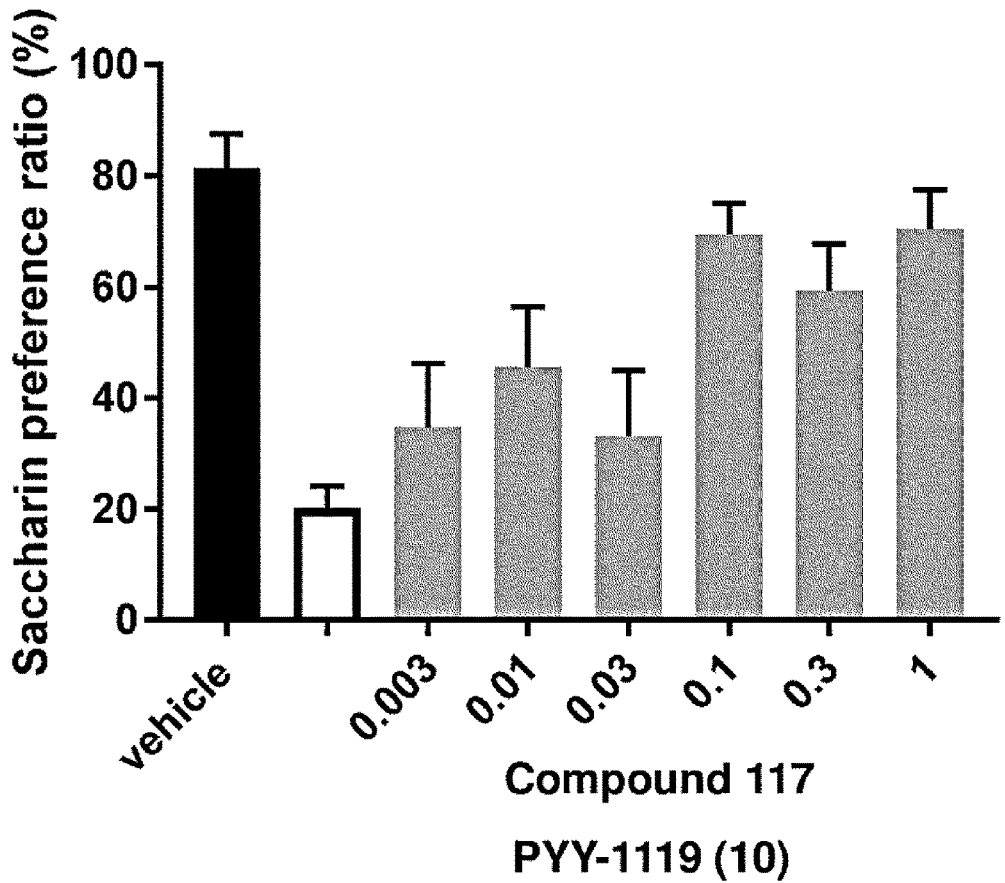
FIG. 1B illustrates the effect of Compound 117 on conditioned taste aversion (CTA) in mice.

Conditioned Taste Aversion Test in Mice (FIG. 1A, FIG. 1B)

0.1% Saccharine water and 14-residue Y2R agonist PYY-1119 (4-imidazolecarbonyl-Ser-D-Hyp-Iva-Pya(4)-Cha-Leu(Me)-Asn-Lys-Aib-Thr-Arg-Gln-Arg-Cha-NH$_2$ (SEQ ID NO: 164), which causes a sense of aversion, were given to male C57BL/6J mice to thereby induce conditioned taste aversion (CTA) to saccharin water, and the action of the compounds of the present invention on the PYY-1119-induced taste aversion was evaluated. The common procedure for the CTA experiment is as follows.

The conditioning was carried out in the following way:
On day 1 and day 3, saccharine water is presented to the mice, and PYY-1119 (10 nmol/kg, s.c.) is administered 10 minutes later. Additionally, the test compound or a solvent is subcutaneously administered simultaneously with PYY-1119.
On day 2, only a solvent is administered 10 minutes after presenting tap water.
On day 4, only tap water is presented.
On day 5, a test of selection from the bottles of saccharine water and tap water is carried out and preferential selection of saccharine water is evaluated.

Compound 6 was dissolved in 10% DMSO/saline and administered simultaneously with PYY-1119 in a dose of 1 nmol/kg, 3 nmol/kg, 10 nmol/kg, 30 nmol/kg, or 100 nmol/kg. As a result, Compound 6 suppressed the PYY-1119-induced taste aversion in a dose-dependent manner (FIG. 1A).

Compound 117 was dissolved in 0.1% Tween 80/10% DMSO/saline and administered simultaneously with PYY-1119 in a dose of 0.003 nmol/kg, 0.01 nmol/kg, 0.03 nmol/kg, 0.1 nmol/kg, 0.3 nmol/kg, or 1 nmol/kg. As a result, Compound 117 suppressed the PYY-1119-induced taste aversion in a dose-dependent manner (FIG. 1B).

Test Example 4

Vomiting Suppression Test in Ferrets

Figure 2A:
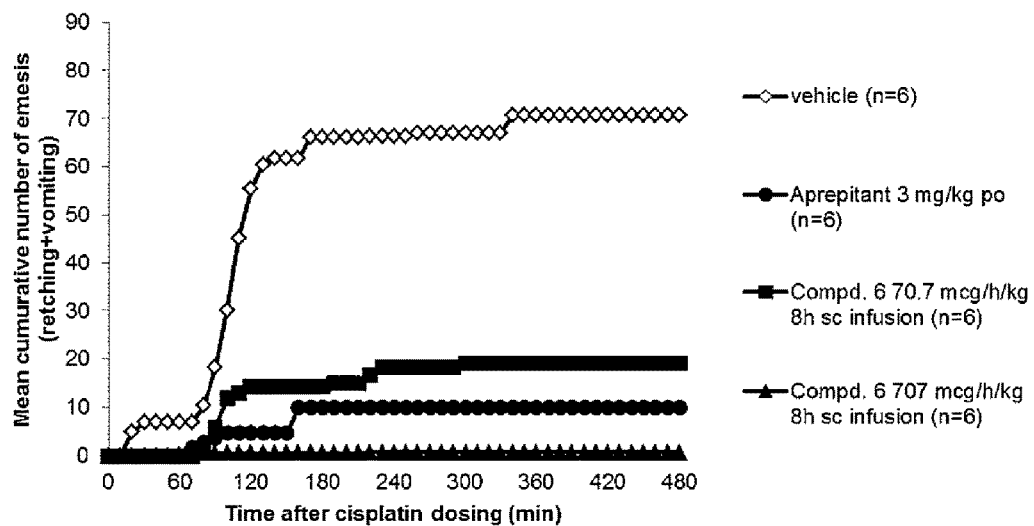
FIG. 2A illustrates the effect of Compound 6 on cisplatin-induced acute vomiting in ferrets.

1. Effect of Subcutaneously Injected Compound 6 in Cisplatin-induced Acute Vomiting Model The ferret test was carried out by Nissei Bilis Co., Ltd. (Shiga prefecture, Japan). Cisplatin (10 mg/kg i.p.) was administered to male ferrets (10-week-old, n=6) to induce acute vomiting. A vehicle (10% DMSO/saline, s.c.), Compound 6 (16.7 or 167 nmol/kg/hour (corresponding to about 70.7 and 707 µg/kg/hour, respectively) was subcutaneously injected, started 1 hour before cisplatin administration) and aprepitant (NK1R antagonist, 3 mg/kg p.o., administered 1 hour before cisplatin administration) were evaluated using the above ferrets. The frequency of emesis (feeling queasy, vomiting) was monitored over a period of 8 hours after cisplatin administration. In the 167 nmol/kg/hour administration, Compound 6 completely eliminated the acute emesis to at least the same extent as the effect by aprepitant (FIG. 2A). The plasma levels of Compound 6 evaluated at the test completion were 133.4 and 392.7 nmol/L in the 16.7 or 167 nmol/kg/hour administration, respectively.

Figure 2B:
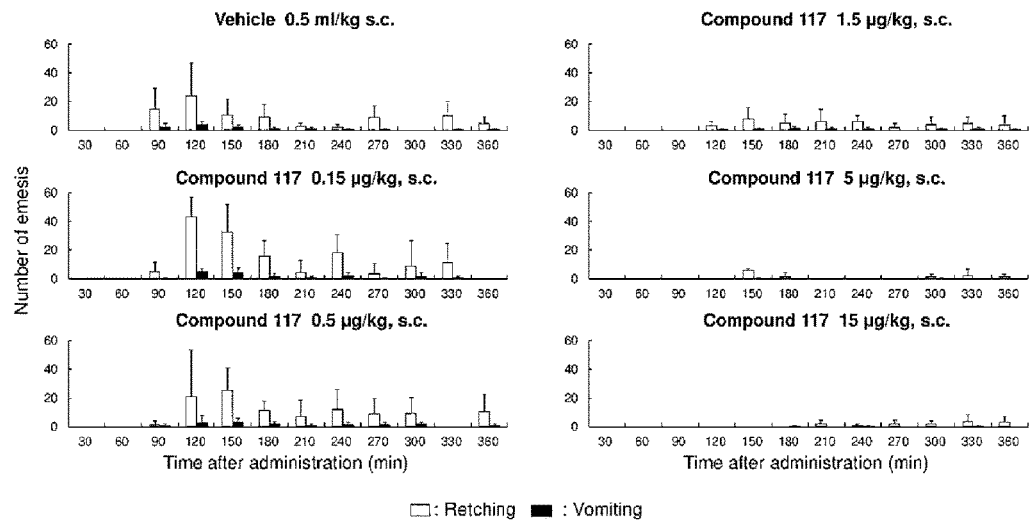
FIG. 2B illustrates the effect of Compound 117 on cisplatin-induced acute vomiting in ferrets. Each value indicates mean±SD (n=4).

2. Effect of Subcutaneously Injected Compound 117 in Cisplatin-induced Acute Emetic Model 24 ferrets were divided into 6 groups of 4 each, and a vehicle (0.09 w/v% tween 80/10% DMSO/saline) and 0.15, 0.5, 1.5, 5, and 15 µg/kg (0.03, 0.1, 0.3, 1, and 3 nmol/kg) of Compound 117 were subcutaneously injected to the groups, respectively, and 1 hour later 10 mg/kg of cisplatin was intraperitoneally administered to each group. Up to 6 hours after cisplatin administration, the condition of the ferrets was monitored to record the frequencies and time points of abdominal contraction motions and vomiting behaviors occurring. As a result, the suppression of the vomiting symptom was noted in a dose-dependent manner in the groups to which Compound 117 was administered (FIG. 2B).

Figure 2C:
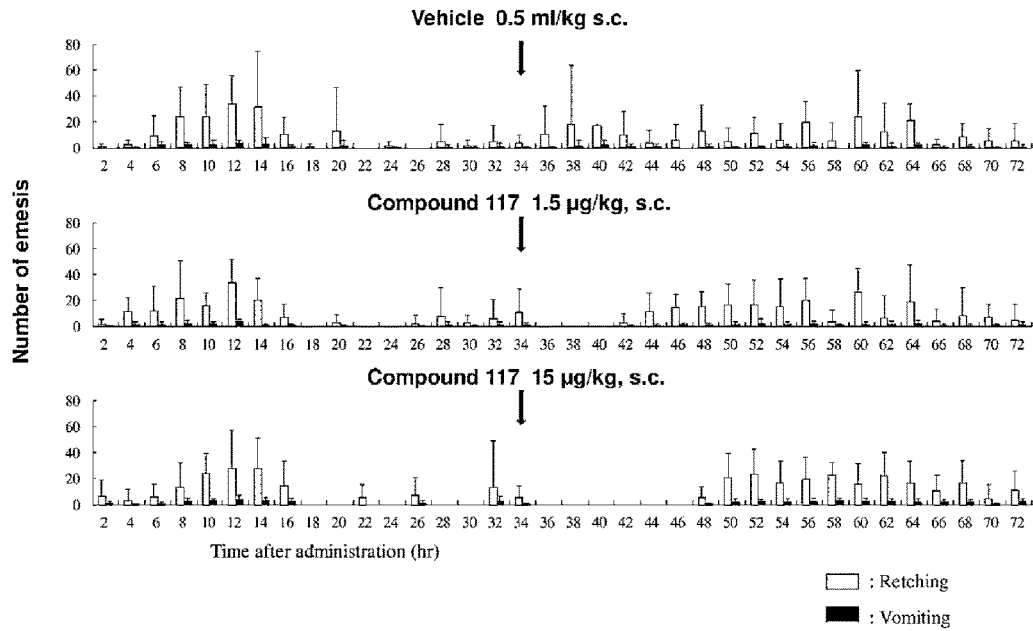
FIG. 2C illustrates the effect of Compound 117 on cisplatin-induced acute vomiting in ferrets. Each value indicates mean±SD (n=7).

3. Effects of Compound 117 and Compound 341 in Cisplatin-induced Delayed Vomiting Model 28 ferrets were divided into 4 groups of 7 each, and 5 mg/kg of cisplatin was intraperitoneally administered, and 34 hours later a vehicle (0.09 w/v % tween 80/10% DMSO/saline), 1.5 µg/kg and 15 µg/kg of Compound 117, and 144 µg/kg of Compound 341 were subcutaneously injected to the groups, respectively. Up to 72 hours after cisplatin administration, the condition of the ferrets was monitored to record the frequencies and time points of abdominal contraction motions and vomiting behaviors occurring. As a result, when 1.5 µg/kg (0.3 nmol/kg) or 15 µg/kg (3 nmol/kg) of Compound 117 was administered, the latency of the vomiting symptom (the time from cisplatin administration to the initial occurrence of the vomiting symptom) was delayed (FIG. 2C) and when 144 µg/kg (30 nmol/kg) of Compound 341 was administered, the suppression of the vomiting symptom was noted.

4. Effect of Subcutaneously Administered GIP Agonist Analogue in Morphine-induced Acute Emetic Model Male ferrets (4-month-old) were repeatedly used until 8-month-old. To evaluate the antiemetic effect, the GIP agonist analogues other than natural human GIP were subcutaneously administered 30 minutes before morphine administration. Natural human GIP was subcutaneously administered 5 minutes before morphine administration. Compound 6 in a dose of 4.2 µg/kg (1 nmol/kg) completely attenuated the morphine (0.6 mg/kg, s.c.)-induced emesis in the ferrets (FIG. 3). Compound 59 (0.45 µg/kg, 0.1 nmol/kg; 4.47 µg/kg, 1 nmol/kg; 13.4 µg/kg, 3 nmol/kg), Compound 75 (4.44 µg/kg, 1 nmol/kg), Compound 104 (4.35 µg/kg, 1 nmol/kg), Compound 113 (0.43 µg/kg, 0.1 nmol/kg; 4.35 µg/kg, 1 nmol/kg), and Compound 117 (4.45 µg/kg, 1 nmol/kg) also suppressed the morphine-induced emesis in ferrets (FIG. 4, FIG. 5).

5. Effects of Subcutaneously Administered Compound 341, Compound 349, 253, 268, 284, 292 and 314 in Morphine-induced Acute Emetic Model 144 µg/kg (30 nmol/kg) of Compound 341, 144 µg/kg (30 nmol/kg) of Compound 349, 144 µg/kg (30 nmol/kg) of Compound 253, 145 µg/kg (30 nmol/kg) of Compound 268, 144 µg/kg (30 nmol/kg) of Compound 284, 145 µg/kg (30 nmol/kg) of Compound 292, and 145 µg/kg (30 nmol/kg) of Compound 314 dessolved with a vehicle (0.09 w/v% tween 80/10% DMSO/saline),respectively, to prepare test solutions. 0.5 mg/kg of the test solutions and the vehicle were subcutaneously administered to ferrets (4 in each group), respectively. At the time of each of 4 hours, or 120 hours after administration, 0.6 mg/kg of morphine was subcutaneously administered. Up to 60 minutes after morphine administration, the condition of the ferrets was monitored to record the frequencies and time points of abdominal contraction motions, vomiting behaviors, licking with the tongue, and fidgety behavior occurring.

Figure 6A:
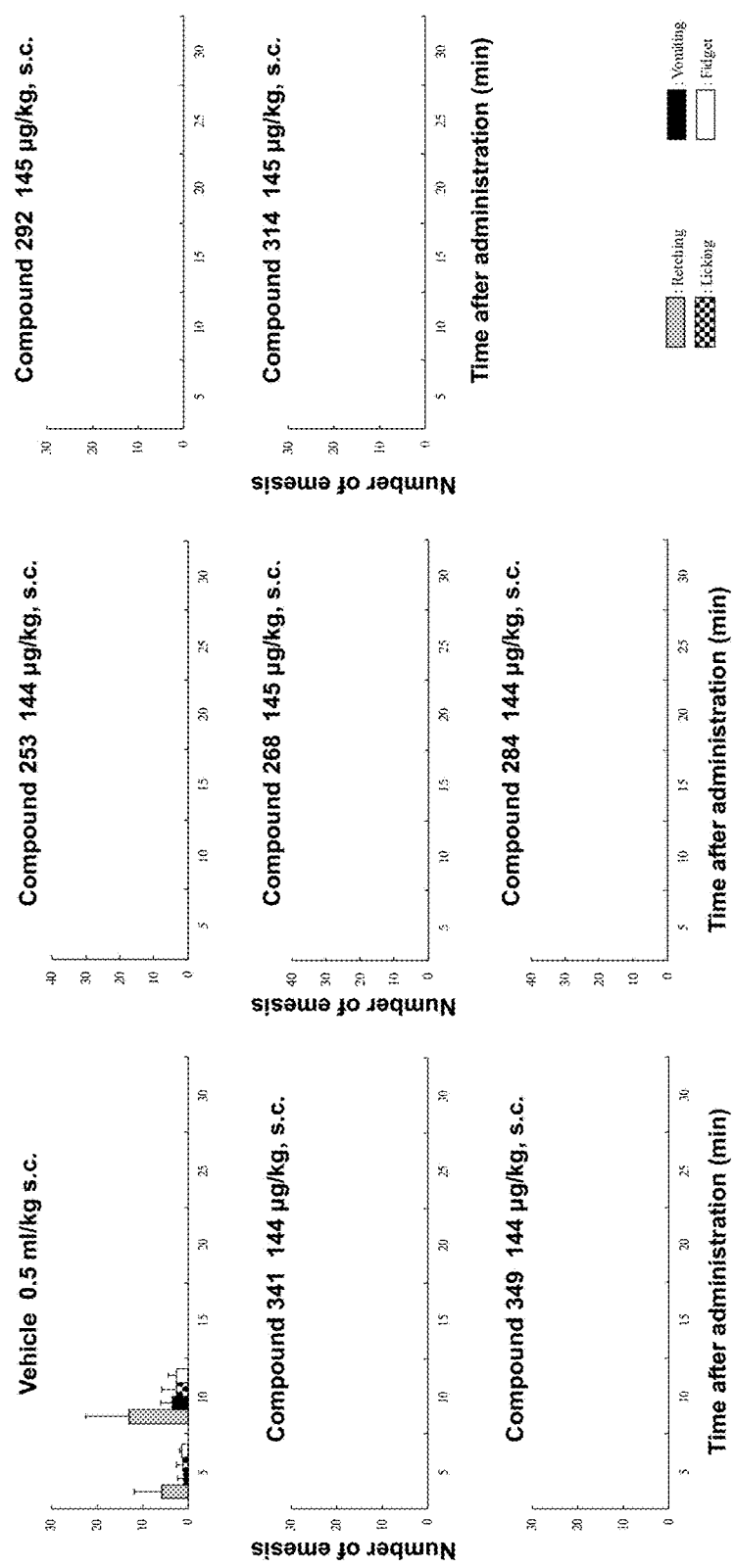
FIG. 6A illustrates the effects of Compounds 341, 349, 253, 268, 284, 292, and 314 on morphine-induced vomiting in ferrets when subcutaneously administered. It shows results of morphine administrations 4 hours after each compound administration. Each value indicates mean±SD (n=4).

As a result, in the experiment wherein morphine was administered 4 hours after administration, the vomiting behavior was noted in all of the 4 ferrets in the vehicle group but the vomiting symptom was observed in none of the 4 ferrets in each of the group receiving 144 µg/kg of Compound 341, the group receiving 144 µg/kg of Compound 349, the group receiving 144 µg/kg of Compound 253, the group receiving 145 µg/kg of Compound 268, the group receiving 144 µg/kg of Compound 284, the group receiving 145 µg/kg of Compound 292, and the group receiving 145 µg/kg of Compound 314 (FIG. 6A). In addition, the plasma levels of Compound 341, Compound 349, Compound 253, Compound 268, Compound 284, Compound 292, and Compound 314 4 hours after administration were 154.0 nmol/L, 143.4 nmol/L, 108.4 nmol/L, 104.9 nmol/L, 163.3 nmol/L, 96.7 nmol/L, and 172.7 nmol/L, respectively.

Furthermore, in the experiment wherein morphine was administered 120 hours after administration, the vomiting behavior was noted in all of the 4 ferrets in the vehicle group but the vomiting symptom was observed in none of the 4 ferrets in the group receiving 144 µg/kg of Compound 341, and the suppression of the vomiting symptom was noted in the group receiving 144 µg/kg of Compound 349 (FIG. 6B). In addition, the plasma levels of Compound 341 and Compound 349 120 hours after administration were 82.3 nmol/L and 43.3 nmol/L, respectively.

6. PYY-1119-induced Vomiting in Dogs

Effects of single subcutaneous administration of Compound 6 and Compound 117 on PYY-1119 (10 µg/kg [about 5 nmol/kg], s.c.)-induced emesis were evaluated in beagles.

Figure 7A:
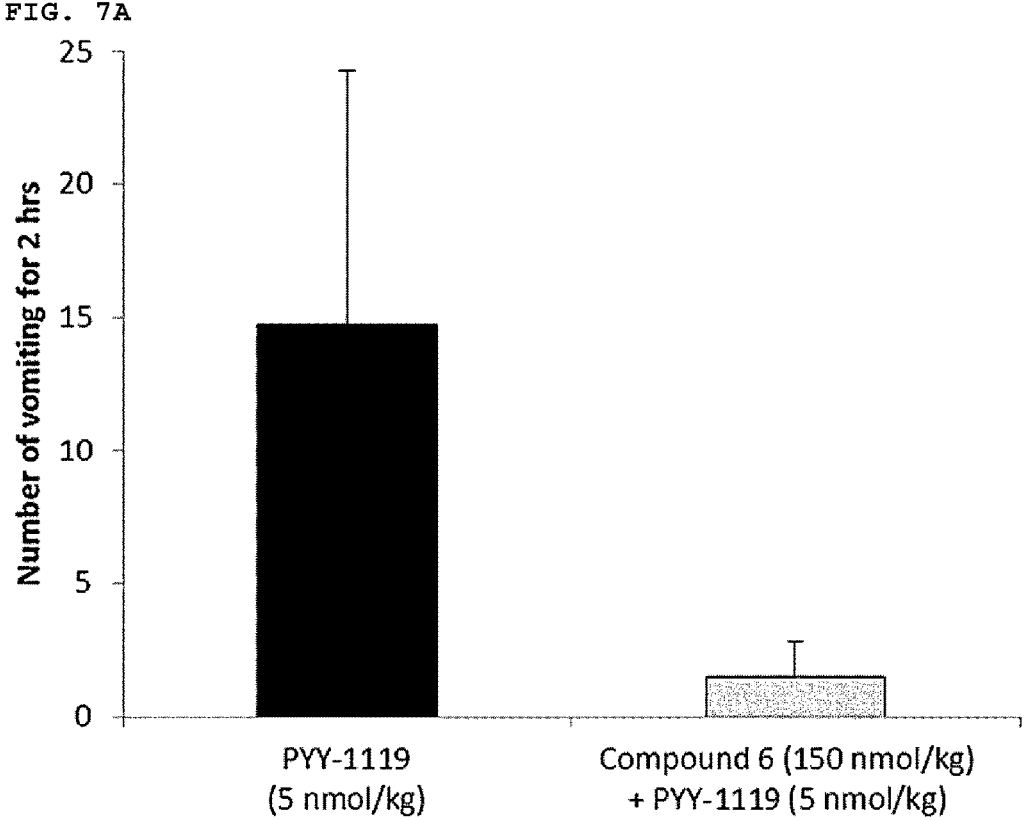
FIG. 7A illustrates the suppression of PYY-1119-induced vomiting by Compound 6 administration in beagles.

For Compound 6, the combined use and PYY-1119 sole administration were tested in 2 female and 2 male cases (24-to 32-month-old) at intervals of 7 days, and Compound 6 was administered 10 minutes before PYY-1119 administration. Compound 6 (150 nmol/kg), during a 2-hour observation period after PYY-1119 administration, notably suppressed the frequency of vomiting to 0 to 3 times, whereas the frequency of vomiting was observed to be 6 to 28 times for PYY-1119 alone (FIG. 7A).

For Compound 117, the test was carried out as a crossover test using 4 female cases (36-month old) at intervals of 7 days, and Compound 117 and a medium thereof were administered 1 hour before PYY-1119 administration. The compound 117 (10 nmol/kg), during a 2-hour observation period after PYY-1119 administration, notably suppressed the frequency of vomiting to 0 to 3 times, whereas the frequency of vomiting was observed to be 8 to 30 times in the medium group, and the average suppression rate of the frequency of vomiting was 93% (FIG. 7B).

Formulation Example 1

| | |
|---|---|
| (1) Compound of Example 1 | 10.0 mg |
| (2) Lactose | 70.0 mg |
| (3) Cornstarch | 50.0 mg |
| (4) Soluble starch | 7.0 mg |
| (5) Magnesium stearate | 3.0 mg |

Compound of Example 1 (10.0 mg) and magnesium stearate (3.0 mg) are granulated with an aqueous soluble starch solution (0.07 mL) (7.0 mg as soluble starch), dried and mixed with lactose (70.0 mg) and cornstarch (50.0 mg). The mixture is compressed to give a tablet.

Formulation Example 2

| | |
|---|---|
| (1) Compound of Example 1 | 5.0 mg |
| (2) Sodium chloride | 20.0 mg |
| (3) Distilled water | to total amount 2 mL |

Compound of Example 1 (5.0 mg) and sodium chloride (20.0 mg) are dissolved in distilled water, and water is added to a total amount of 2.0 ml. The solution is filtered, and filled in a 2 ml ampoule under aseptic conditions. The ampoule is sterilized and tightly sealed to give a solution for injection.

INDUSTRIAL APPLICABILITY

The compound of the present invention has superior GIP receptor selective agonist activity, and is useful as a drug for the prophylaxis or treatment of various diseases associated with GIP receptor, for example, diabetes, obesity, disease associated with vomiting or nausea and the like.

All the publications, patents, and the patent applications cited herein are incorporated herein by reference in their entireties.

FREE TEXT FOR SEQUENCE LISTING

SEQ ID NO: 1: Synthetic peptide
SEQ ID NO: 2: Synthetic peptide
SEQ ID NO: 3: Synthetic peptide SEQ ID NO: 4: Synthetic peptide (Reference Example 1)
SEQ ID NO: 5: Synthetic peptide (Reference Example 2)
SEQ ID NO: 6: Synthetic peptide (Reference Example 3)
SEQ ID NOs: 7 to 163: Synthetic peptides (Compounds 1 to 157, respectively))
SEQ ID NO: 164: Synthetic peptide (PYY-1119)
SEQ ID NO: 165: Synthetic peptide (formula (I))
SEQ ID NO: 166: Synthetic peptide (formula (II))
SEQ ID NO: 167: Synthetic peptide (formula (III))
SEQ ID NO: 168: Synthetic peptide (formula (IV))
SEQ ID NO: 169: Synthetic peptide (formula (V))
SEQ ID NO: 170: Synthetic peptide (formula (VI))
SEQ ID NOs: 171 to 480: Synthetic peptides (Compounds 158 to 467, respectively)
SEQ ID NO: 481: Synthetic peptide (Reference Example A: Compound 468) SEQ ID NO: 482: Synthetic peptide (Reference Example B: Compound 469)
SEQ ID NO: 483: Synthetic peptide (Reference Example C: Compound 470)
SEQ ID NOs: 484 to 535: Synthetic peptides (Compounds 471 to 522, respectively)
SEQ ID NOs: 536 to 565: Synthetic peptides
SEQ ID NO: 566: Synthetic peptide (formula (X)
SEQ ID NOs: 567 to 569: Synthetic peptide (formulas (VII) to (IX))
[Sequence Listing]
PT38-90190317_Sequence listing.txt

SEQUENCE LISTING (569 sequences)

SEQ ID NO: 1 - protein, 40 aa, Artificial Sequence
  Synthetic Peptide (Formula (I))
  MISC_FEATURE (2)..(2): Xaa stands for Aib or D-Ala
  MISC_FEATURE (6)..(6): Xaa stands for Iva, Phe, alpha-MePhe or Val
  MISC_FEATURE (7)..(7): Xaa stands for Ile, Lys or Val
  MISC_FEATURE (9)..(9): Xaa stands for Asp, Leu or Phe
  MISC_FEATURE (11)..(11): Xaa stands for Aib or Ser
  MISC_FEATURE (13)..(13): Xaa stands for Aib, Ala, Gln,Leu,Tyr or D-Iva
  MISC_FEATURE (15)..(15): Xaa stands for Asp, Glu, Lys,Ser or Tyr
  MISC_FEATURE (16)..(16): Xaa stands for Arg or Lys
  MISC_FEATURE (17)..(17): Xaa stands for Aib, Gln or Ile
  MISC_FEATURE (18)..(18): Xaa stands for Ala or His
  MISC_FEATURE (19)..(19): Xaa stands for Gln or Ser
  MISC_FEATURE (20)..(20): Xaa stands for Aib, Ala or Gln
  MISC_FEATURE (21)..(21): Xaa stands for Glu, Asn, Asp, Ser or Leu
  MISC_FEATURE (22)..(22): Xaa stands for Phe or alpha-MePhe
  MISC_FEATURE (22)..(22): Xaa stands for Phe or alpha-MePhe
  MISC_FEATURE (23)..(23): Xaa stands for Ile or Val
  MISC_FEATURE (24)..(24): Xaa stands for Lys, Lys(Ac), Arg or Asn
  MISC_FEATURE (26)..(26): Xaa stands for Aib, Leu or Iva
  MISC_FEATURE (28)..(28): Xaa stands for Ala, Arg, Lys or Lys(Ac)
  MISC_FEATURE (29)..(29): Xaa stands for Gln or Gly
  MISC_FEATURE (30)..(30): Xaa stands for Arg or Gly
  MISC_FEATURE (39)..(39): Xaa stands for Lys or Ser
  MISC_FEATURE (40)..(40): Xaa stands for Arg, Lys or none
YXEGTXXSXYXIXLXXXXXXXXXXWXLXXXPSSGAPPPXX

SEQ ID NO: 2 - protein, 40 aa, Artificial Sequence
  Synthetic Peptide (Formula (II))
  MISC_FEATURE (2)..(2): Xaa stands for Aib or D-Ala
  MISC_FEATURE (7)..(7): Xaa stands for Ile, Lys or Val
  MISC_FEATURE (9)..(9): Xaa stands for Asp, Leu or Phe
  MISC_FEATURE (13)..(13): Xaa stands for Aib, Ala, Gln, Leu or Tyr
  MISC_FEATURE (15)..(15): Xaa stands for Asp, Glu, Lys, Ser or Tyr
  MISC_FEATURE (17)..(17): Xaa stands for Gln or Ile
  MISC_FEATURE (18)..(18): Xaa stands for Ala or His
  MISC_FEATURE (19)..(19): Xaa stands for Gln or Ser
  MISC_FEATURE (20)..(20): Xaa stands for Aib or Gln
  MISC_FEATURE (21)..(21): Xaa stands for Glu or Leu
  MISC_FEATURE (23)..(23): Xaa stands for Ile or Val
  MISC_FEATURE (24)..(24): Xaa stands for Lys or Lys(Ac)
  MISC_FEATURE (26)..(26): Xaa stands for Aib or Leu
  MISC_FEATURE (28)..(28): Xaa stands for Lys or Lys(Ac)
  MISC_FEATURE (39)..(39): Xaa stands for Lys or Ser
  MISC_FEATURE (40)..(40): Xaa stands for Lys or none
YXEGTVXSXYSIXLXKXXXXXFXXWXLXGGPSSGAPPPXX

SEQ ID NO: 3 - protein, 40 aa, Artificial Sequence
  Synthetic Peptide (Formula (III))
  MISC_FEATURE (2)..(2): Xaa stands for Aib
  MISC_FEATURE (6)..(6): Xaa stands for Iva, Phe, alpha-MePhe or Val
  MISC_FEATURE (7)..(7): Xaa stands for Ile or Val
  MISC_FEATURE (9)..(9): Xaa stands for Asp or Leu
  MISC_FEATURE (11)..(11): Xaa stands for Aib or Ser
  MISC_FEATURE (13)..(13): Xaa stands for Aib, Ala or D-Iva
  MISC_FEATURE (17)..(17): Xaa stands for Aib, Gln or Ile
  MISC_FEATURE (18)..(18): Xaa stands for Ala or His
  MISC_FEATURE (20)..(20): Xaa stands for Aib, Ala or Gln
  MISC_FEATURE (21)..(21): Xaa stands for Asn, Asp, Glu or Ser
  MISC_FEATURE (22)..(22): Xaa stands for Phe or alpha-MePhe
  MISC_FEATURE (24)..(24): Xaa stands for Arg or Asn
  MISC_FEATURE (26)..(26): Xaa stands for Iva or Leu
  MISC_FEATURE (28)..(28): Xaa stands for Ala or Arg
  MISC_FEATURE (29)..(29): Xaa stands for Gln or Gly
  MISC_FEATURE (30)..(30): Xaa stands for Arg or Gly
  MISC_FEATURE (40)..(40): Xaa stands for Arg or none
YXEGTXXSXYXIXLDRXXQXXXVXWXLXXXPSSGAPPPSX

SEQ ID NO: 4 - protein, 20 aa, Artificial Sequence
  Synthetic Peptide (Reference Example 1)
EFVKWLLKGGPSSGAPPPSK

SEQ ID NO: 5 - protein, 28 aa, Artificial Sequence
  Synthetic Peptide (Reference Example 2)
  MISC_FEATURE (1)..(1): Xaa stands for Aib
  MISC_FEATURE (8)..(8): Xaa stands for Aib
  MISC_FEATURE (14)..(14): Xaa stands for Aib
XLDKQAQXEFVKWXLKGGPSSGAPPPSK

SEQ ID NO: 6 - protein, 10 aa, Artificial Sequence
  Synthetic Peptide (Reference Example 3)
PSSGAPPPSR

SEQ ID NO: 7 - protein, 40 aa, Artificial Sequence
  Synthetic Peptide (Compound 1)
  MISC_FEATURE (2)..(2): Xaa stands for Aib
  MISC_FEATURE (20)..(20): Xaa stands for Aib
YXEGTVISDYSIYLDKQAQXEFVKWLLKGGPSSGAPPPSK

SEQ ID NO: 8 - protein, 40 aa, Artificial Sequence
  Synthetic Peptide (Compound 2)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVISDYSIXLDKQAQXEFVKWLLKGGPSSGAPPPSK

SEQ ID NO: 9 - protein, 40 aa, Artificial Sequence
  Synthetic Peptide (Compound 3)
  MISC_FEATURE (2)..(2): Xaa stands for Aib
  MISC_FEATURE (20)..(20): Xaa stands for Aib
YXEGTVVSDYSIYLDKQAQXEFVKWLLKGGPSSGAPPPSK

SEQ ID NO: 10 - protein, 40 aa, Artificial Sequence
  Synthetic Peptide (Compound 4)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSDYSIXLDKQAQXEFVKWLLKGGPSSGAPPPSK

SEQ ID NO: 11 - protein, 40 aa, Artificial Sequence
  Synthetic Peptide (Compound 5)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSDYSIXLKKQAQXEFVKWLLKGGPSSGAPPPSK

SEQ ID NO: 12 - protein, 40 aa, Artificial Sequence
  Synthetic Peptide (Compound 6)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXEFVKWLLKGGPSSGAPPPSK

SEQ ID NO: 13 - protein, 40 aa, Artificial Sequence
  Synthetic Peptide (Compound 7)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSFYSIXLDKQAQXEFVKWLLKGGPSSGAPPPSK

SEQ ID NO: 14 - protein, 40 aa, Artificial Sequence
  Synthetic Peptide (Compound 8)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVKSDYSIXLDKQAQXEFVKWLLKGGPSSGAPPPSK

SEQ ID NO: 15 - protein, 40 aa, Artificial Sequence
  Synthetic Peptide (Compound 9)
  MISC_FEATURE (2)..(2): Xaa stands for Aib
  MISC_FEATURE (20)..(20): Xaa stands for Aib
YXEGTVKSDYSIQLDKQAQXEFVKWLLKGGPSSGAPPPSK

SEQ ID NO: 16 - protein, 40 aa, Artificial Sequence
  Synthetic Peptide (Compound 10)
  MISC_FEATURE (2)..(2): Xaa stands for Aib
  MISC_FEATURE (20)..(20): Xaa stands for Aib
YXEGTVKSDYSILLDKQAQXEFVKWLLKGGPSSGAPPPSK

SEQ ID NO: 17 - protein, 40 aa, Artificial Sequence; identical to SEQ ID NO: 12
  Synthetic Peptide (Compound 11)
  MISC_FEATURE (1)..(1): N-terminal Acetylation
  MISC_FEATURE (2)..(2): Xaa stands for Aib
  MISC_FEATURE (13)..(13): Xaa stands for Aib
  MISC_FEATURE (20)..(20): Xaa stands for Aib

SEQ ID NO: 18 - protein, 40 aa, Artificial Sequence; identical to SEQ ID NO: 16
  Synthetic Peptide (Compound 12)
  MISC_FEATURE (1)..(1): N-terminal Acetylation
  MISC_FEATURE (2)..(2): Xaa stands for Aib
  MISC_FEATURE (20)..(20): Xaa stands for Aib

SEQ ID NO: 19 - protein, 40 aa, Artificial Sequence; identical to SEQ ID NO: 12
  Synthetic Peptide (Compound 13)
  MISC_FEATURE (1)..(1): N-terminal Methylation
  MISC_FEATURE (2)..(2): Xaa stands for Aib
  MISC_FEATURE (13)..(13): Xaa stands for Aib
  MISC_FEATURE (20)..(20): Xaa stands for Aib

SEQ ID NO: 20 - protein, 40 aa, Artificial Sequence; identical to SEQ ID NO: 16
  Synthetic Peptide (Compound 14)
  MISC_FEATURE (1)..(1): N-terminal Methylation
  MISC_FEATURE (2)..(2): Xaa stands for Aib
  MISC_FEATURE (20)..(20): Xaa stands for Aib

SEQ ID NO: 21 - protein, 40 aa, Artificial Sequence
  Synthetic Peptide (Compound 15)
  MISC_FEATURE (2)..(2): D-Alanine
  MISC_FEATURE (20)..(20): Xaa stands for Aib
YAEGTVVSLYSIALDKQAQXEFVKWLLKGGPSSGAPPPSK

SEQ ID NO: 22 - protein, 40 aa, Artificial Sequence
  Synthetic Peptide (Compound 16)
  MISC_FEATURE (2)..(2): D-Alanine
  MISC_FEATURE (13)..(13): Xaa stands for Aib
  MISC_FEATURE (20)..(20): Xaa stands for Aib
YAEGTVVSLYSIXLDKQHQXEFVKWLLKGGPSSGAPPPSK

SEQ ID NO: 23 - protein, 40 aa, Artificial Sequence
  Synthetic Peptide (Compound 17)
  MISC_FEATURE (2)..(2): D-Alanine
  MISC_FEATURE (13)..(13): Xaa stands for Aib
  MISC_FEATURE (20)..(20): Xaa stands for Aib
YAEGTVVSLYSIXLYKQHQXEFVKWLLKGGPSSGAPPPSK

SEQ ID NO: 24 - protein, 40 aa, Artificial Sequence
  Synthetic Peptide (Compound 18)
  MISC_FEATURE (2)..(2): D-Alanine
  MISC_FEATURE (13)..(13): D-Alanine
YAEGTVVSLYSIXLDKQHQQEFVKWLLKGGPSSGAPPPSK

SEQ ID NO: 25 - protein, 40 aa, Artificial Sequence
  Synthetic Peptide (Compound 19)
  MISC_FEATURE (2)..(2): D-Alanine
  MISC_FEATURE (13)..(13): Xaa stands for Aib
  MISC_FEATURE (20)..(20): Xaa stands for Aib
YAEGTVVSLYSIXLDKIHQXEFVKWLLKGGPSSGAPPPSK

SEQ ID NO: 26 - protein, 40 aa, Artificial Sequence
  Synthetic Peptide (Compound 20)
  MISC_FEATURE (2)..(2): D-Alanine
  MISC_FEATURE (13)..(13): D-Alanine
YAEGTVVSLYSIXLDKIHQQEFVKWLLKGGPSSGAPPPSK

SEQ ID NO: 27 - protein, 40 aa, Artificial Sequence
  Synthetic Peptide (Compound 21)
  MISC_FEATURE (2)..(2): D-Alanine
  MISC_FEATURE (13)..(13): D-Alanine
YAEGTVVSLYSIXLYKIHQQEFVKWLLKGGPSSGAPPPSK

SEQ ID NO: 28 - protein, 40 aa, Artificial Sequence
  Synthetic Peptide (Compound 22)
  MISC_FEATURE (2)..(2): D-Alanine
  MISC_FEATURE (20)..(20): Xaa stands for Aib
YAEGTVVSLYSIALDKQHQXEFVKWLLKGGPSSGAPPPSK

SEQ ID NO: 29 - protein, 40 aa, Artificial Sequence
  Synthetic Peptide (Compound 23)
  MISC_FEATURE (2)..(2): D-Alanine
  MISC_FEATURE (20)..(20): Xaa stands for Aib
YAEGTVVSLYSIALDKIHQXEFVKWLLKGGPSSGAPPPSK

SEQ ID NO: 30 - protein, 40 aa, Artificial Sequence
  Synthetic Peptide (Compound 24)
  MISC_FEATURE (2)..(2): D-Alanine
YAEGTVVSLYSIALDKQHQQEFVKWLLKGGPSSGAPPPSK

SEQ ID NO: 31 - protein, 40 aa, Artificial Sequence
  Synthetic Peptide (Compound 25)
  MISC_FEATURE (2)..(2): D-Alanine
YAEGTVVSLYSIALDKIHQQEFVKWLLKGGPSSGAPPPSK

SEQ ID NO: 32 - protein, 40 aa, Artificial Sequence
  Synthetic Peptide (Compound 26)
  MISC_FEATURE (2)..(2): D-Alanine
YAEGTVVSLYSIALYKIHQQEFVKWLLKGGPSSGAPPPSK

SEQ ID NO: 33 - protein, 40 aa, Artificial Sequence
  Synthetic Peptide (Compound 27)
  MISC_FEATURE (2)..(2): D-Alanine
  MISC_FEATURE (13)..(13): Xaa stands for Aib
  MISC_FEATURE (20)..(20): Xaa stands for Aib
YAEGTVVSLYSIXLDKQAQXEFVKWLLKGGPSSGAPPPSK

SEQ ID NO: 34 - protein, 40 aa, Artificial Sequence; identical to SEQ ID NO: 33
  Synthetic Peptide (Compound 28)
  MISC_FEATURE (2)..(2): D-Alanine
  MISC_FEATURE (13)..(13): Xaa stands for Aib
  MISC_FEATURE (20)..(20): Xaa stands for Aib

SEQ ID NO: 35 - protein, 40 aa, Artificial Sequence
  Synthetic Peptide (Compound 29)
  MISC_FEATURE (2)..(2)
  MISC_FEATURE (13)..(13)
  MISC_FEATURE (20)..(20)
YXEGTVVSLYSIXLDKQHQXEFVKWLLKGGPSSGAPPPSK

SEQ ID NO: 36 - protein, 40 aa, Artificial Sequence
  Synthetic Peptide (Compound 30)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDRQAQXEFVRWLLRGGPSSGAPPPSR

SEQ ID NO: 37 - protein, 39 aa, Artificial Sequence
  Synthetic Peptide (Compound 31)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXEFVKWLLKGGPSSGAPPPK

SEQ ID NO: 38 - protein, 40 aa, Artificial Sequence
  Synthetic Peptide (Compound 32)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVISLYSIXLDKQAQXEFVKWLLKGGPSSGAPPPSK

SEQ ID NO: 39 - protein, 40 aa, Artificial Sequence
  Synthetic Peptide (Compound 33)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKQAQXEFVKWLLKGGPSSGAPPPSK

SEQ ID NO: 40 - protein, 40 aa, Artificial Sequence
  Synthetic Peptide (Compound 34)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLSKQAQXEFVKWLLKGGPSSGAPPPSK

SEQ ID NO: 41 - protein, 40 aa, Artificial Sequence
  Synthetic Peptide (Compound 35)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKIAQXEFVKWLLKGGPSSGAPPPSK

SEQ ID NO: 42 - protein, 40 aa, Artificial Sequence
  Synthetic Peptide (Compound 36)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQASXEFVKWLLKGGPSSGAPPPSK

SEQ ID NO: 43 - protein, 40 aa, Artificial Sequence
  Synthetic Peptide (Compound 37)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXLFVKWLLKGGPSSGAPPPSK

SEQ ID NO: 44 - protein, 40 aa, Artificial Sequence
  Synthetic Peptide (Compound 38)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXEFIKWLLKGGPSSGAPPPSK

SEQ ID NO: 45 - protein, 40 aa, Artificial Sequence; identical to SEQ ID NO: 12
  Synthetic Peptide (Compound 39)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (24)..(24): Acetylation

SEQ ID NO: 46 - protein, 39 aa, Artificial Sequence
  Synthetic Peptide (Compound 40)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDKQAQXEFVKWLLKGGPSSGAPPPS

SEQ ID NO: 47 - protein, 40 aa, Artificial Sequence; identical to SEQ ID NO: 12
  Synthetic Peptide (Compound 41)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (28)..(28): Acetylation

SEQ ID NO: 48 - protein, 40 aa, Artificial Sequence
  Synthetic Peptide (Compound 42)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (26)..(26): Xaa stands for Aib
YXEGTVVSLYSIXLDKQAQXEFVKWXLKGGPSSGAPPPSK

SEQ ID NO: 49 - protein, 40 aa, Artificial Sequence; identical to SEQ ID NO: 10
  Synthetic Peptide (Compound 43)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (28)..(28): Acetylation

SEQ ID NO: 50 - protein, 40 aa, Artificial Sequence
  Synthetic Peptide (Compound 44)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (26)..(26): Xaa stands for Aib
YXEGTVVSDYSIXLDKQAQXEFVKWXLKGGPSSGAPPPSK

SEQ ID NO: 51 - protein, 40 aa, Artificial Sequence
  Synthetic Peptide (Compound 45)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVISLYSIXLEKQAQXEFVKWLLKGGPSSGAPPPSK

SEQ ID NO: 52 - protein, 40 aa, Artificial Sequence
  Synthetic Peptide (Compound 46)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKIAQXEFVKWLLKGGPSSGAPPPSK

SEQ ID NO: 53 - protein, 40 aa, Artificial Sequence
  Synthetic Peptide (Compound 47)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKQHQXEFVKWLLKGGPSSGAPPPSK

SEQ ID NO: 54 - protein, 40 aa, Artificial Sequence
  Synthetic Peptide (Compound 48)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKQASXEFVKWLLKGGPSSGAPPPSK

SEQ ID NO: 55 - protein, 40 aa, Artificial Sequence
  Synthetic Peptide (Compound 49)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLEKQAQXEFIKWLLKGGPSSGAPPPSK

SEQ ID NO: 56 - protein, 40 aa, Artificial Sequence; identical to SEQ ID NO: 39
  Synthetic Peptide (Compound 50)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (24)..(24): Acetylation

SEQ ID NO: 57 - protein, 40 aa, Artificial Sequence
  Synthetic Peptide (Compound 51)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVISLYSIXLEKQAQXEFIKWLLKGGPSSGAPPPSK

SEQ ID NO: 58 - protein, 39 aa, Artificial Sequence; identical to SEQ ID NO: 46
  Synthetic Peptide (Compound 52)
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (28)..(28): Acetylation

SEQ ID NO: 59 - protein, 39 aa, Artificial Sequence
  Synthetic Peptide (Compound 53)
  MISC_FEATURE (1)..(1): N-terminal Methylation
  MISC_FEATURE (2)..(2): Xaa stands for Aib
  MISC_FEATURE (20)..(20): Xaa stands for Aib
YXEGTFISDYSIALDRIHQXNFVNWLLAQRPSSGAPPPS

SEQ ID NO: 60 - protein, 39 aa, Artificial Sequence
  Synthetic Peptide (Compound 54)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDRQAQXEFVRWLLRGGPSSGAPPPS

SEQ ID NO: 61 - protein, 40 aa, Artificial Sequence
  Synthetic Peptide (Compound 55)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDRQAQXEFVRWLLAQRPSSGAPPPSR

SEQ ID NO: 62 - protein, 39 aa, Artificial Sequence
  Synthetic Peptide (Compound 56)
  MISC_FEATURE (2)..(2): Xaa stands for Aib
  MISC_FEATURE (13)..(13): Xaa stands for Aib
  MISC_FEATURE (20)..(20): Xaa stands for Aib
YXEGTVVSLYSIXLDRQAQXEFVRWLLAQRPSSGAPPPS

SEQ ID NO: 63 - protein, 40 aa, Artificial Sequence
  Synthetic Peptide (Compound 57)
  MISC_FEATURE (2)..(2): Xaa stands for Aib
  MISC_FEATURE (11)..(11): Xaa stands for Aib
  MISC_FEATURE (13)..(13): Xaa stands for Aib
  MISC_FEATURE (20)..(20): Xaa stands for Aib
YXEGTVVSLYXIXLDRQAQXEFVRWLLRGGPSSGAPPPSR

SEQ ID NO: 64 - protein, 40 aa, Artificial Sequence
  Synthetic Peptide (Compound 58)
  MISC_FEATURE (2)..(2): Xaa stands for Aib
  MISC_FEATURE (13)..(13): Xaa stands for Aib
YXEGTVVSLYSIXLDRQAQAEFVRWLLRGGPSSGAPPPSR

SEQ ID NO: 65 - protein, 40 aa, Artificial Sequence
  Synthetic Peptide (Compound 59)
  MISC_FEATURE (1)..(1): N-terminal Methylation
  MISC_FEATURE (2)..(2): Xaa stands for Aib
YXEGTFISDYSIALDRIAQQDFVNWLLAQRPSSGAPPPSR

SEQ ID NO: 66 - protein, 40 aa, Artificial Sequence
  Synthetic Peptide (Compound 60)
  MISC_FEATURE (1)..(1): N-terminal Methylation
  MISC_FEATURE (2)..(2): Xaa stands for Aib
YXEGTFISDYSIALDRIAQQSFVNWLLAQRPSSGAPPPSR

SEQ ID NO: 67 - protein, 39 aa, Artificial Sequence
  Synthetic Peptide (Compound 61)
  MISC_FEATURE (1)..(1): N-terminal Methylation
  MISC_FEATURE (2)..(2): Xaa stands for Aib
  MISC_FEATURE (26)..(26): Xaa stands for Iva
YXEGTFISDYSIALDRIAQQDFVNWXLAQRPSSGAPPPS

SEQ ID NO: 68 - protein, 39 aa, Artificial Sequence
  Synthetic Peptide (Compound 62)
  MISC_FEATURE (1)..(1): N-terminal Methylation
  MISC_FEATURE (2)..(2): Xaa stands for Aib
  MISC_FEATURE (22)..(22): alpha-Methylation
YXEGTFISDYSIALDRIAQQDFVNWLLAQRPSSGAPPPS

SEQ ID NO: 69 - protein, 39 aa, Artificial Sequence
  Synthetic Peptide (Compound 63)
  MISC_FEATURE (1)..(1): N-terminal Methylation
  MISC_FEATURE (2)..(2): Xaa stands for Aib
  MISC_FEATURE (13)..(13): Xaa stands for D-Iva
YXEGTFISDYSIXLDRIAQQDFVNWLLAQRPSSGAPPPS

SEQ ID NO: 70 - protein, 39 aa, Artificial Sequence
  Synthetic Peptide (Compound 64)
  MISC_FEATURE (1)..(1): N-terminal Methylation
  MISC_FEATURE (2)..(2): Xaa stands for Aib
  MISC_FEATURE (6)..(6): Xaa stands for Iva
YXEGTXISDYSIALDRIAQQDFVNWLLAQRPSSGAPPPS

SEQ ID NO: 71 - protein, 40 aa, Artificial Sequence; identical to SEQ ID NO: 65
  Synthetic Peptide (Compound 65)
  MISC_FEATURE (1)..(1): N-terminal Methylation
  MISC_FEATURE (2)..(2): Xaa stands for Aib
  MISC_FEATURE (22)..(22): alpha-Methylation

SEQ ID NO: 72 - protein, 40 aa, Artificial Sequence
  Synthetic Peptide (Compound 66)
  MISC_FEATURE (1)..(1): N-terminal Methylation
  MISC_FEATURE (2)..(2): Xaa stands for Aib
  MISC_FEATURE (22)..(22): alpha-Methylation
  MISC_FEATURE (26)..(26): Xaa stands for Iva
YXEGTFISDYSIALDRIAQQDFVNWXLAQRPSSGAPPPSR

SEQ ID NO: 73 - protein, 40 aa, Artificial Sequence
  Synthetic Peptide (Compound 67)
  MISC_FEATURE (1)..(1): N-terminal Methylation
  MISC_FEATURE (2)..(2): Xaa stands for Aib
  MISC_FEATURE (26)..(26): Xaa stands for Iva
YXEGTFISDYSIALDRIAQQSFVNWXLAQRPSSGAPPPSR

SEQ ID NO: 74 - protein, 40 aa, Artificial Sequence
  Synthetic Peptide (Compound 68)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (26)..(26): Xaa stands for Iva
YXEGTFISDYSIALDRIAQXNFVNWXLAQRPSSGAPPPSR

SEQ ID NO: 75 - protein, 40 aa, Artificial Sequence
  Synthetic Peptide (Compound 69)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (26)..(26): Xaa stands for Iva
YXEGTFISDYSIALDRXAQQDFVNWXLAQRPSSGAPPPSR

SEQ ID NO: 76 - protein, 40 aa, Artificial Sequence
  Synthetic Peptide (Compound 70)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (26)..(26): Xaa stands for Iva
YXEGTFISDYSIXLDRIAQQDFVNWXLAQRPSSGAPPPSR

SEQ ID NO: 77 - protein, 40 aa, Artificial Sequence; identical to SEQ ID NO: 66
  Synthetic Peptide (Compound 71)
  MISC_FEATURE (1)..(1): N-terminal Methylation
  MISC_FEATURE (2)..(2): Xaa stands for Aib
  MISC_FEATURE (22)..(22): alpha-Methylation

SEQ ID NO: 78 - protein, 40 aa, Artificial Sequence
  Synthetic Peptide (Compound 72)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (22)..(22): alpha-Methylation
YXEGTFISDYSIALDRIAQXNFVNWLLAQRPSSGAPPPSR

SEQ ID NO: 79 - protein, 40 aa, Artificial Sequence
  Synthetic Peptide (Compound 73)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (22)..(22): alpha-Methylation
YXEGTFISDYSIALDRXAQQDFVNWLLAQRPSSGAPPPSR

SEQ ID NO: 80 - protein, 40 aa, Artificial Sequence
  Synthetic Peptide (Compound 74)
  MISC_FEATURE (1)..(1): N-terminal Methylation
  MISC_FEATURE (2)..(2): Xaa stands for Aib
  MISC_FEATURE (13)..(13): Xaa stands for Iva
  MISC_FEATURE (22)..(22): alpha-Methylation
YXEGTFISDYSIXLDRIAQQDFVNWLLAQRPSSGAPPPSR

SEQ ID NO: 81 - protein, 40 aa, Artificial Sequence; identical to SEQ ID NO: 73
  Synthetic Peptide (Compound 75)
  MISC_FEATURE (1)..(1): N-terminal Methylation
  MISC_FEATURE (2)..(2): Xaa stands for Aib
  MISC_FEATURE (22)..(22): alpha-Methylation
  MISC_FEATURE (26)..(26): Xaa stands for Iva

SEQ ID NO: 82 - protein, 40 aa, Artificial Sequence; identical to SEQ ID NO: 74
  Synthetic Peptide (Compound 76)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 83 - protein, 40 aa, Artificial Sequence; identical to SEQ ID NO: 75
  Synthetic Peptide (Compound 77)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (22)..(22): alpha-Methylation
  MISC_FEATURE (26)..(26): Xaa stands for Iva

SEQ ID NO: 84 - protein, 40 aa, Artificial Sequence; identical to SEQ ID NO: 76
  Synthetic Peptide (Compound 78)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (22)..(22): alpha-Methylation
  MISC_FEATURE (26)..(26): Xaa stands for Iva

SEQ ID NO: 85 - protein, 40 aa, Artificial Sequence
  Synthetic Peptide (Compound 79)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
YXEGTFISDYSIXLDRXAQQDFVNWLLAQRPSSGAPPPSR

SEQ ID NO: 86 - protein, 40 aa, Artificial Sequence
  Synthetic Peptide (Compound 80)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
YXEGTXISDYSIXLDRIAQQDFVNWLLAQRPSSGAPPPSR

SEQ ID NO: 87 - protein, 40 aa, Artificial Sequence; identical to SEQ ID NO: 85
  Synthetic Peptide (Compound 81)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
  MISC_FEATURE (22)..(22): alpha-Methylation

SEQ ID NO: 88 - protein, 40 aa, Artificial Sequence
  Synthetic Peptide (Compound 82)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
YXEGTFISDYSIALDRXAQXNFVNWLLAQRPSSGAPPPSR

SEQ ID NO: 89 - protein, 40 aa, Artificial Sequence
  Synthetic Peptide (Compound 83)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (20)..(20): Xaa stands for Aib
YXEGTFISDYSIXLDRIAQXNFVNWLLAQRPSSGAPPPSR

SEQ ID NO: 90 - protein, 40 aa, Artificial Sequence
  Synthetic Peptide (Compound 84)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIALDRXAQXNFVNWXLAQRPSSGAPPPSR

SEQ ID NO: 91 - protein, 40 aa, Artificial Sequence
  Synthetic Peptide (Compound 85)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIXLDRXAQXNFVNWXLAQRPSSGAPPPSR

SEQ ID NO: 92 - protein, 40 aa, Artificial Sequence
  Synthetic Peptide (Compound 86)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (22)..(22): alpha-Methylation
  MISC_FEATURE (26)..(26): Xaa stands for Iva
YXEGTXISDYSIXLDRXAQQDFVNWXLAQRPSSGAPPPSR

SEQ ID NO: 93 - protein, 40 aa, Artificial Sequence
  Synthetic Peptide (Compound 87)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXLDRXAQXNFVNWXLAQRPSSGAPPPSR

SEQ ID NO: 94 - protein, 40 aa, Artificial Sequence
  Synthetic Peptide (Compound 88)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (26)..(26): Xaa stands for Iva
YXEGTXISDYSIALDRIAQQDFVNWXLAQRPSSGAPPPSR

SEQ ID NO: 95 - protein, 40 aa, Artificial Sequence
  Synthetic Peptide (Compound 89)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (22)..(22): alpha-Methylation
YXEGTXISDYSIALDRIAQQDFVNWLLAQRPSSGAPPPSR

SEQ ID NO: 96 - protein, 40 aa, Artificial Sequence
  Synthetic Peptide (Compound 90)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (20)..(20): Xaa stands for Aib
YXEGTXISDYSIALDRIAQXNFVNWLLAQRPSSGAPPPSR

SEQ ID NO: 97 - protein, 40 aa, Artificial Sequence
  Synthetic Peptide (Compound 91)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
YXEGTXISDYSIALDRXAQQDFVNWLLAQRPSSGAPPPSR

SEQ ID NO: 98 - protein, 40 aa, Artificial Sequence
  Synthetic Peptide (Compound 92)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (20)..(20): Xaa stands for Aib
  MISC_FEATURE (26)..(26): Xaa stands for Iva
YXEGTFISDYSIXLDRIAQXNFVNWXLAQRPSSGAPPPSR

SEQ ID NO: 99 - protein, 40 aa, Artificial Sequence
  Synthetic Peptide (Compound 93)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
  MISC_FEATURE (26)..(26): Xaa stands for D-Iva
YXEGTFISDYSIXLDRXAQQDFVNWXLAQRPSSGAPPPSR

SEQ ID NO: 100 - protein, 40 aa, Artificial Sequence
  Synthetic Peptide (Compound 94)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (26)..(26): Xaa stands for Iva
YXEGTXISDYSIXLDRIAQQDFVNWXLAQRPSSGAPPPSR

SEQ ID NO: 101 - protein, 40 aa, Artificial Sequence; identical to SEQ ID NO: 94
  Synthetic Peptide (Compound 95)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (22)..(22): alpha-Methylation
  MISC_FEATURE (26)..(26): Xaa stands for Iva

SEQ ID NO: 102 - protein, 40 aa, Artificial Sequence
  Synthetic Peptide (Compound 96)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (20)..(20): Xaa stands for Aib
  MISC_FEATURE (26)..(26): Xaa stands for Iva
YXEGTXISDYSIALDRIAQXNFVNWXLAQRPSSGAPPPSR

SEQ ID NO: 103 - protein, 40 aa, Artificial Sequence
  Synthetic Peptide (Compound 97)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (26)..(26): Xaa stands for Iva
YXEGTXISDYSIALDRXAQQDFVNWXLAQRPSSGAPPPSR

SEQ ID NO: 104 - protein, 40 aa, Artificial Sequence; identical to SEQ ID NO: 88
  Synthetic Peptide (Compound 98)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (22)..(22): alpha-Methylation

SEQ ID NO: 105 - protein, 40 aa, Artificial Sequence; identical to SEQ ID NO: 89
  Synthetic Peptide (Compound 99)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (20)..(20): Xaa stands for Aib
  MISC_FEATURE (22)..(22): alpha-Methylation

SEQ ID NO: 106 - protein, 40 aa, Artificial Sequence; identical to SEQ ID NO: 96
  Synthetic Peptide (Compound 100)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (20)..(20): Xaa stands for Aib
  MISC_FEATURE (22)..(22): alpha-Methylation

SEQ ID NO: 107 - protein, 40 aa, Artificial Sequence; identical to SEQ ID NO: 97
  Synthetic Peptide (Compound 101)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (22)..(22): alpha-Methylation

SEQ ID NO: 108 - protein, 40 aa, Artificial Sequence; identical to SEQ ID NO: 86
  Synthetic Peptide (Compound 102)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (22)..(22): alpha-Methylation

SEQ ID NO: 109 - protein, 40 aa, Artificial Sequence
  Synthetic Peptide (Compound 103)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for D-Iva
  MISC_FEATURE (20)..(20): Xaa stands for D-Iva
YXEGTFISDYSIXLDRXAQXNFVNWLLAQRPSSGAPPPSR

SEQ ID NO: 110 - protein, 40 aa, Artificial Sequence
  Synthetic Peptide (Compound 104)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Iva
  MISC_FEATURE (20)..(20): Xaa stands for Iva
YXEGTXISDYSIALDRXAQXNFVNWLLAQRPSSGAPPPSR

SEQ ID NO: 111 - protein, 40 aa, Artificial Sequence
  Synthetic Peptide (Compound 105)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
YXEGTXISDYSIXLDRXAQQDFVNWLLAQRPSSGAPPPSR

SEQ ID NO: 112 - protein, 40 aa, Artificial Sequence; identical to SEQ ID NO: 109
  Synthetic Peptide (Compound 106)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (22)..(22): alpha-Methylation

SEQ ID NO: 113 - protein, 40 aa, Artificial Sequence; identical to SEQ ID NO: 110
  Synthetic Peptide (Compound 107)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib
  MISC_FEATURE (22)..(22): alpha-Methylation

SEQ ID NO: 114 - protein, 40 aa, Artificial Sequence
  Synthetic Peptide (Compound 108)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (20)..(20): Xaa stands for Aib
  MISC_FEATURE (22)..(22): alpha-Methylation
YXEGTXISDYSIXLDRIAQXNFVNWLLAQRPSSGAPPPSR

SEQ ID NO: 115 - protein, 40 aa, Artificial Sequence; identical to SEQ ID NO: 111
  Synthetic Peptide (Compound 109)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (22)..(22): alpha-Methylation

SEQ ID NO: 116 - protein, 40 aa, Artificial Sequence
  Synthetic Peptide (Compound 110)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
YXEGTXISDYSIXLDRXAQXNFVNWLLAQRPSSGAPPPSR

SEQ ID NO: 117 - protein, 40 aa, Artificial Sequence; identical to SEQ ID NO: 116
  Synthetic Peptide (Compound 111)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (22)..(22): alpha-Methylation

SEQ ID NO: 118 - protein, 40 aa, Artificial Sequence
  Synthetic Peptide (Compound 112)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIALDRXAQXNFVNWXLAQRPSSGAPPPSR

SEQ ID NO: 119 - protein, 40 aa, Artificial Sequence; identical to SEQ ID NO: 93
  Synthetic Peptide (Compound 113)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 120 - protein, 40 aa, Artificial Sequence; identical to SEQ ID NO: 90
  Synthetic Peptide (Compound 114)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 121 - protein, 40 aa, Artificial Sequence; identical to SEQ ID NO: 118
  Synthetic Peptide (Compound 115)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 122 - protein, 40 aa, Artificial Sequence; identical to SEQ ID NO: 93
  Synthetic Peptide (Compound 116)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 123 - protein, 40 aa, Artificial Sequence
  Synthetic Peptide (Compound 117)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIALDRXHQXNFVNWXLAQRPSSGAPPPSR

SEQ ID NO: 124 - protein, 40 aa, Artificial Sequence
  Synthetic Peptide (Compound 118)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (22)..(22): alpha-Methylation
  MISC_FEATURE (26)..(26): Xaa stands for Iva
YXEGTXISDYSIXLDRXHQQDFVNWXLAQRPSSGAPPPSR

SEQ ID NO: 125 - protein, 40 aa, Artificial Sequence
  Synthetic Peptide (Compound 119)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXLDRXHQXNFVNWXLAQRPSSGAPPPSR

SEQ ID NO: 126 - protein, 40 aa, Artificial Sequence
  Synthetic Peptide (Compound 120)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (26)..(26): Xaa stands for Iva
YXEGTXISDYSIALDRIHQQSFVNWXLAQRPSSGAPPPSR

SEQ ID NO: 127 - protein, 40 aa, Artificial Sequence; identical to SEQ ID NO: 90
  Synthetic Peptide (Compound 121)
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 128 - protein, 40 aa, Artificial Sequence; identical to SEQ ID NO: 92
  Synthetic Peptide (Compound 122)
  MISC_FEATURE (2)..(2): Xaa stands for Aib
  MISC_FEATURE (6)..(6): Xaa stands for Iva
  MISC_FEATURE (13)..(13): Xaa stands for D-Iva
  MISC_FEATURE (17)..(17): Xaa stands for Aib
  MISC_FEATURE (22)..(22): alpha-Methylation
  MISC_FEATURE (26)..(26): Xaa stands for Iva

SEQ ID NO: 129 - protein, 40 aa, Artificial Sequence
  Synthetic Peptide (Compound 123)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (26)..(26): Xaa stands for Iva
YXEGTFISDYSIALDRIAQXDFVNWXLAQRPSSGAPPPSR

SEQ ID NO: 130 - protein, 40 aa, Artificial Sequence
  Synthetic Peptide (Compound 124)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (26)..(26): Xaa stands for Iva
YXEGTFISDYSIALDRIAQXSFVNWXLAQRPSSGAPPPSR

SEQ ID NO: 131 - protein, 40 aa, Artificial Sequence; identical to SEQ ID NO: 130
  Synthetic Peptide (Compound 125)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 132 - protein, 40 aa, Artificial Sequence
  Synthetic Peptide (Compound 126)
  MISC_FEATURE (1)..(1): N-terminal Methylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIALDRXAQXSFVNWXLAQRPSSGAPPPSR

SEQ ID NO: 133 - protein, 40 aa, Artificial Sequence
  Synthetic Peptide (Compound 127)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (26)..(26): Xaa stands for Iva
YXEGTXISDYSIALDRIAQQSFVNWXLAQRPSSGAPPPSR

SEQ ID NO: 134 - protein, 40 aa, Artificial Sequence
  Synthetic Peptide (Compound 128)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (26)..(26): Xaa stands for Iva
YXEGTXISDYSIALDRXAQQSFVNWXLAQRPSSGAPPPSR

SEQ ID NO: 135 - protein, 39 aa, Artificial Sequence
  Synthetic Peptide (Compound 129)
  MISC_FEATURE (1)..(1): N-terminal Methylation
  MISC_FEATURE (2)..(2): Xaa stands for Aib
YXEGTFISDYSIALDRIAQQSFVNWLLAQRPSSGAPPPS

SEQ ID NO: 136 - protein, 40 aa, Artificial Sequence; identical to SEQ ID NO: 72
  Synthetic Peptide (Compound 130)
  MISC_FEATURE (1)..(1): N-terminal Methylation
  MISC_FEATURE (2)..(2): Xaa stands for Aib
  MISC_FEATURE (26)..(26): Xaa stands for Iva

SEQ ID NO: 137 - protein, 40 aa, Artificial Sequence; identical to SEQ ID NO: 80
  Synthetic Peptide (Compound 131)
  MISC_FEATURE (1)..(1): N-terminal Methylation
  MISC_FEATURE (2)..(2): Xaa stands for Aib
  MISC_FEATURE (13)..(13): Xaa stands for D-Iva

SEQ ID NO: 138 - protein, 40 aa, Artificial Sequence; identical to SEQ ID NO: 95
  Synthetic Peptide (Compound 132)
  MISC_FEATURE (1)..(1): N-terminal Methylation
  MISC_FEATURE (2)..(2): Xaa stands for Aib
  MISC_FEATURE (6)..(6): Xaa stands for Iva

SEQ ID NO: 139 - protein, 40 aa, Artificial Sequence
  Synthetic Peptide (Compound 133)
  MISC_FEATURE (1)..(1): N-terminal Methylation
  MISC_FEATURE (2)..(2): Xaa stands for Aib
  MISC_FEATURE (26)..(26): Xaa stands for Iva
YXEGTFISDYSIALDRIAQQNFVNWXLAQRPSSGAPPPSR

SEQ ID NO: 140 - protein, 40 aa, Artificial Sequence
  Synthetic Peptide (Compound 134)
  MISC_FEATURE (1)..(1): N-terminal Methylation
  MISC_FEATURE (2)..(2): Xaa stands for Aib
  MISC_FEATURE (22)..(22): alpha-Methylation
YXEGTFISDYSIALDRIAQQNFVNWLLAQRPSSGAPPPSR

SEQ ID NO: 141 - protein, 40 aa, Artificial Sequence
  Synthetic Peptide (Compound 135)
  MISC_FEATURE (1)..(1): N-terminal Methylation
  MISC_FEATURE (2)..(2): Xaa stands for Aib
  MISC_FEATURE (20)..(20): Xaa stands for Aib
  MISC_FEATURE (22)..(22): alpha-Methylation
YXEGTFISDYSIALDRIAQXDFVNWLLAQRPSSGAPPPSR

SEQ ID NO: 142 - protein, 40 aa, Artificial Sequence
  Synthetic Peptide (Compound 136)
  MISC_FEATURE (1)..(1): N-terminal Methylation
  MISC_FEATURE (2)..(2): Xaa stands for Aib
  MISC_FEATURE (20)..(20): Xaa stands for Aib
YXEGTFISDYSIALDRIAQXSFVNWLLAQRPSSGAPPPSR

SEQ ID NO: 143 - protein, 40 aa, Artificial Sequence
  Synthetic Peptide (Compound 137)
  MISC_FEATURE (1)..(1): N-terminal Methylation
  MISC_FEATURE (2)..(2): Xaa stands for Aib
  MISC_FEATURE (17)..(17): Xaa stands for Aib
YXEGTFISDYSIALDRXAQQSFVNWLLAQRPSSGAPPPSR

SEQ ID NO: 144 - protein, 40 aa, Artificial Sequence
  Synthetic Peptide (Compound 138)
  MISC_FEATURE (1)..(1): N-terminal Methylation
  MISC_FEATURE (2)..(2): Xaa stands for Aib
  MISC_FEATURE (13)..(13): Xaa stands for D-Iva
YXEGTFISDYSIXLDRIAQQSFVNWLLAQRPSSGAPPPSR

SEQ ID NO: 145 - protein, 40 aa, Artificial Sequence
  Synthetic Peptide (Compound 139)
  MISC_FEATURE (1)..(1): N-terminal Methylation
  MISC_FEATURE (2)..(2): Xaa stands for Aib
  MISC_FEATURE (6)..(6): Xaa stands for Iva
YXEGTXISDYSIALDRIAQQSFVNWLLAQRPSSGAPPPSR

SEQ ID NO: 146 - protein, 40 aa, Artificial Sequence
  Synthetic Peptide (Compound 140)
  MISC_FEATURE (1)..(1): N-terminal Methylation
  MISC_FEATURE (2)..(2): Xaa stands for Aib
  MISC_FEATURE (26)..(26): Xaa stands for Iva
YXEGTFISDYSIALDRIHQQDFVNWXLAQRPSSGAPPPSR

SEQ ID NO: 147 - protein, 40 aa, Artificial Sequence
  Synthetic Peptide (Compound 141)
  MISC_FEATURE (1)..(1): N-terminal Methylation
  MISC_FEATURE (2)..(2): Xaa stands for Aib
  MISC_FEATURE (22)..(22): alpha-Methylation
YXEGTFISDYSIALDRIHQQDFVNWLLAQRPSSGAPPPSR

SEQ ID NO: 148 - protein, 40 aa, Artificial Sequence
  Synthetic Peptide (Compound 142)
  MISC_FEATURE (1)..(1): N-terminal Methylation
  MISC_FEATURE (2)..(2): Xaa stands for Aib
  MISC_FEATURE (20)..(20): Xaa stands for Aib
YXEGTFISDYSIALDRIHQXNFVNWLLAQRPSSGAPPPSR

SEQ ID NO: 149 - protein, 40 aa, Artificial Sequence
  Synthetic Peptide (Compound 143)
  MISC_FEATURE (1)..(1): N-terminal Methylation
  MISC_FEATURE (2)..(2): Xaa stands for Aib
  MISC_FEATURE (17)..(17): Xaa stands for Aib
YXEGTFISDYSIALDRXHQQDFVNWLLAQRPSSGAPPPSR

SEQ ID NO: 150 - protein, 40 aa, Artificial Sequence
  Synthetic Peptide (Compound 144)
  MISC_FEATURE (1)..(1): N-terminal Methylation
  MISC_FEATURE (2)..(2): Xaa stands for Aib
  MISC_FEATURE (13)..(13): Xaa stands for D-Iva
YXEGTFISDYSIXLDRIHQQDFVNWLLAQRPSSGAPPPSR

SEQ ID NO: 151 - protein, 40 aa, Artificial Sequence
  Synthetic Peptide (Compound 145)
  MISC_FEATURE (1)..(1): N-terminal Methylation
  MISC_FEATURE (2)..(2): Xaa stands for Aib
  MISC_FEATURE (6)..(6): Xaa stands for Iva
YXEGTXISDYSIALDRIHQQDFVNWLLAQRPSSGAPPPSR

SEQ ID NO: 152 - protein, 40 aa, Artificial Sequence
  Synthetic Peptide (Compound 146)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva
YXEGTXISDYSIXLDRIAQXSFVNWXLAQRPSSGAPPPSR

SEQ ID NO: 153 - protein, 40 aa, Artificial Sequence
  Synthetic Peptide (Compound 147)
  MISC_FEATURE (1)..(1): N-terminal Methylation
  MISC_FEATURE (2)..(2): Xaa stands for Aib
  MISC_FEATURE (13)..(13): Xaa stands for D-Iva
  MISC_FEATURE (20)..(20): Xaa stands for Aib
  MISC_FEATURE (26)..(26): Xaa stands for Iva
YXEGTFISDYSIXLDRIHQXNFVNWXLAQRPSSGAPPPSR

SEQ ID NO: 154 - protein, 40 aa, Artificial Sequence
  Synthetic Peptide (Compound 148)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib
YXEGTXISDYSIALDRXHQXNFVNWLLAQRPSSGAPPPSR

SEQ ID NO: 155 - protein, 40 aa, Artificial Sequence; identical to SEQ ID NO: 125
  Synthetic Peptide (Compound 149)
  MISC_FEATURE (1)..(1): N-terminal Methylation
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 156 - protein, 40 aa, Artificial Sequence; identical to SEQ ID NO: 90
  Synthetic Peptide (Compound 150)
  MISC_FEATURE (1)..(1): N-terminal Acethylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 157 - protein, 40 aa, Artificial Sequence; identical to SEQ ID NO: 96
  Synthetic Peptide (Compound 151)
  MISC_FEATURE (1)..(1): N-terminal Acethylation
  MISC_FEATURE (2)..(2): Xaa stands for Aib
  MISC_FEATURE (6)..(6): Xaa stands for Iva
  MISC_FEATURE (20)..(20): Xaa stands for Aib

SEQ ID NO: 158 - protein, 40 aa, Artificial Sequence; identical to SEQ ID NO: 98
  Synthetic Peptide (Compound 152)
  MISC_FEATURE (1)..(1): N-terminal Acethylation
  MISC_FEATURE (2)..(2): Xaa stands for Aib
  MISC_FEATURE (13)..(13): Xaa stands for D-Iva
  MISC_FEATURE (20)..(20): Xaa stands for Aib
  MISC_FEATURE (26)..(26): Xaa stands for Iva

SEQ ID NO: 159 - protein, 40 aa, Artificial Sequence; identical to SEQ ID NO: 110
  Synthetic Peptide (Compound 153)
  MISC_FEATURE (1)..(1): N-terminal Acethylation
  MISC_FEATURE (2)..(2): Xaa stands for Aib
  MISC_FEATURE (6)..(6): Xaa stands for Iva
  MISC_FEATURE (17)..(17): Xaa stands for Aib
  MISC_FEATURE (20)..(20): Xaa stands for Aib

SEQ ID NO: 160 - protein, 40 aa, Artificial Sequence; identical to SEQ ID NO: 93
  Synthetic Peptide (Compound 154)
  MISC_FEATURE (1)..(1): N-terminal Acethylation
  MISC_FEATURE (2)..(2): Xaa stands for Aib
  MISC_FEATURE (6)..(6): Xaa stands for Iva
  MISC_FEATURE (13)..(13): Xaa stands for Iva
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 161 - protein, 40 aa, Artificial Sequence; identical to SEQ ID NO: 130
  Synthetic Peptide (Compound 155)
  MISC_FEATURE (1)..(1): N-terminal Acethylation
  MISC_FEATURE (2)..(2): Xaa stands for Aib
  MISC_FEATURE (20)..(20): Xaa stands for Aib
  MISC_FEATURE (22)..(22): alpha-Methylation
  MISC_FEATURE (26)..(26): Xaa stands for Iva

SEQ ID NO: 162 - protein, 40 aa, Artificial Sequence; identical to SEQ ID NO: 123
  Synthetic Peptide (Compound 156)
  MISC_FEATURE (1)..(1): N-terminal Acethylation
  MISC_FEATURE (2)..(2): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 163 - protein, 40 aa, Artificial Sequence; identical to SEQ ID NO: 125
  Synthetic Peptide (Compound 157)
  MISC_FEATURE (1)..(1): N-terminal Acethylation
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 164 - protein, 14 aa, Artificial Sequence
  Synthetic Peptide (PYY-1119)
  MISC_FEATURE (1)..(1): N-terminal, 4-imidazolecarbonylation
  MISC_FEATURE (2)..(2): Xaa stands for D-Hyp
  MISC_FEATURE (3)..(3): Xaa stands for Iva
  MISC_FEATURE (4)..(4): Xaa stands for Pya(4)
  MISC_FEATURE (5)..(5): Xaa stands for Cha
  MISC_FEATURE (6)..(6): Methylation
  MISC_FEATURE (9)..(9): Xaa stands for Aib
  MISC_FEATURE (14)..(14): Xaa stands for Cha
SXXXXLNKXTRQRX

SEQ ID NO: 165 - protein, 40 aa, Artificial Sequence
  Synthetic Peptide (Formula (I))
  MISC_FEATURE (2)..(2): Xaa stands for Aib or D-Ala
  MISC_FEATURE (6)..(6): Xaa stands for Iva, Phe, or Val
  MISC_FEATURE (7)..(7): Xaa stands for Ile, Lys, or Val
  MISC_FEATURE (8)..(8): Xaa stands for Ser
  MISC_FEATURE (8)..(30): any one or two amino acids selected from (8)..(30) optionally represent Lys(R), and R represents a substituent group
  MISC_FEATURE (9)..(9): Xaa stands for Asp, Leu, or Phe
  MISC_FEATURE (10)..(10): Xaa stands for Tyr
  MISC_FEATURE (11)..(11): Xaa stands for Aib or Ser
  MISC_FEATURE (12)..(12): Xaa stands for Ile
  MISC_FEATURE (13)..(13): Xaa stands for Aib, Ala, Gln, Leu, Tyr, or D-Iva
  MISC_FEATURE (14)..(14): Xaa stands for Leu
  MISC_FEATURE (15)..(15): Xaa stands for Asp, Glu, Lys, Ser, or Tyr
  MISC_FEATURE (16)..(16): Xaa stands for Arg or Lys
  MISC_FEATURE (17)..(17): Xaa stands for Aib, Gln, or Ile
  MISC_FEATURE (18)..(18): Xaa stands for Ala or His
  MISC_FEATURE (19)..(19): Xaa stands for Gln or Ser
  MISC_FEATURE (20)..(20): Xaa stands for Aib, Ala, or Gln
  MISC_FEATURE (21)..(21): Xaa stands for Asn, Asp, Glu, Leu, or Ser
  MISC_FEATURE (22)..(22): Xaa stands for Phe or  alpha-MePhe
  MISC_FEATURE (23)..(23): Xaa stands for Ile or Val
  MISC_FEATURE (24)..(24): Xaa stands for Arg, Asn, Asp, Lys, or Lys(Ac)
  MISC_FEATURE (25)..(25): Xaa stands for Trp
  MISC_FEATURE (26)..(26): Xaa stands for Aib, Iva, or Leu
  MISC_FEATURE (27)..(27): Xaa stands for Leu
  MISC_FEATURE (28)..(28): Xaa stands for Ala, Arg, Lys, or Lys(Ac)
  MISC_FEATURE (29)..(29): Xaa stands for Gln or Gly
  MISC_FEATURE (30)..(30): Xaa stands for Arg, Gly, or a deletion
  MISC_FEATURE (31)..(31): Xaa stands for Pro or a deletion
  MISC_FEATURE (31)..(40): when (31)..(40) stand for deletions, (2) stands for Aib
  MISC_FEATURE (32)..(32): Xaa stands for Ser or a deletion
  MISC_FEATURE (33)..(33): Xaa stands for Ser or a deletion
  MISC_FEATURE (34)..(34): Xaa stands for Gly or a deletion
  MISC_FEATURE (35)..(35): Xaa stands for Ala or a deletion
  MISC_FEATURE (36)..(36): Xaa stands for Pro or a deletion
  MISC_FEATURE (37)..(37): Xaa stands for Pro or a deletion
  MISC_FEATURE (38)..(38): Xaa stands for Pro or a deletion
  MISC_FEATURE (39)..(39): Xaa stands for Lys, Ser, or a deletion
  MISC_FEATURE (40)..(40): Xaa stands for  Arg, Lys, or a deletion
YXEGTXXXXXXXXXXXXXXXXXXXXXXXXXXXXXXXXXXX

SEQ ID NO: 166 - protein, 40 aa, Artificial Sequence
  Synthetic Peptide (Formula (II))
  MISC_FEATURE (2)..(2): Xaa stands for Aib or D-Ala
  MISC_FEATURE (6)..(6): Xaa stands for Iva, Phe, or Val
  MISC_FEATURE (7)..(7): Xaa stands for Ile, Lys, or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp, Leu, or Phe
  MISC_FEATURE (10)..(10): Xaa stands for Tyr
  MISC_FEATURE (11)..(11): Xaa stands for Aib or Ser
  MISC_FEATURE (12)..(12): Xaa stands for Ile
  MISC_FEATURE (13)..(13): Xaa stands for Aib, Ala, Gln, Leu, Tyr, or D-Iva
  MISC_FEATURE (14)..(14): Xaa stands for Leu
  MISC_FEATURE (15)..(15): Xaa stands for Asp, Glu, Lys, Ser, or Tyr
  MISC_FEATURE (16)..(16): Xaa stands for Arg or Lys
  MISC_FEATURE (17)..(17): Xaa stands for Aib, Gln, or Ile
  MISC_FEATURE (18)..(18): Xaa stands for Ala or His
  MISC_FEATURE (19)..(19): Xaa stands for Gln or Ser
  MISC_FEATURE (20)..(20): Xaa stands for Aib, Ala, or Gln
  MISC_FEATURE (21)..(21): Xaa stands for Asn, Asp, Glu, Leu or Ser
  MISC_FEATURE (22)..(22): Xaa stands for Phe or alpha-MePhe
  MISC_FEATURE (23)..(23): Xaa stands for Ile or Val
  MISC_FEATURE (24)..(24): Xaa stands for Arg, Asn, Asp,  Lys, or Lys(Ac)
  MISC_FEATURE (25)..(25): Xaa stands for Trp
  MISC_FEATURE (26)..(26): Xaa stands for Aib, Iva, or Leu
  MISC_FEATURE (27)..(27): Xaa stands for Leu
  MISC_FEATURE (28)..(28): Xaa stands for Ala, Arg, Lys, or Lys(Ac)
  MISC_FEATURE (29)..(29): Xaa stands for Gln or Gly
  MISC_FEATURE (30)..(30): Xaa stands for Arg or Gly
  MISC_FEATURE (39)..(39): Xaa stands for Lys or Ser
  MISC_FEATURE (40)..(40): Xaa stands for Arg, Lys, or a deletion
YXEGTXXXXXXXXXXXXXXXXXXXXXXXXXPSSGAPPPXX

SEQ ID NO: 167 - protein, 40 aa, Artificial Sequence
  Synthetic Peptide (Formula (III))
  MISC_FEATURE (2)..(2): Xaa stands for Aib or D-Ala
  MISC_FEATURE (7)..(7): Xaa stands for Ile, Lys, or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp, Leu, or Phe
  MISC_FEATURE (10)..(10): Xaa stands for Tyr
  MISC_FEATURE (11)..(11): Xaa stands for Ser
  MISC_FEATURE (12)..(12): Xaa stands for Ile
  MISC_FEATURE (13)..(13): Xaa stands for Aib, Ala, Gln, Leu, or Tyr
  MISC_FEATURE (14)..(14): Xaa stands for Leu
  MISC_FEATURE (15)..(15): Xaa stands for Asp, Glu, Lys, Ser, or Tyr
  MISC_FEATURE (16)..(16): Xaa stands for Lys
  MISC_FEATURE (17)..(17): Xaa stands for Gln, or Ile
  MISC_FEATURE (18)..(18): Xaa stands for Ala or His
  MISC_FEATURE (19)..(19): Xaa stands for Gln or Ser
  MISC_FEATURE (20)..(20): Xaa stands for Aib, or Gln
  MISC_FEATURE (21)..(21): Xaa stands for Glu, or Leu
  MISC_FEATURE (22)..(22): Xaa stands for Phe
  MISC_FEATURE (23)..(23): Xaa stands for Ile or Val
  MISC_FEATURE (24)..(24): Xaa stands for Lys, or Lys(Ac)
  MISC_FEATURE (25)..(25): Xaa stands for Trp
  MISC_FEATURE (26)..(26): Xaa stands for Aib, or Leu
  MISC_FEATURE (27)..(27): Xaa stands for Leu
  MISC_FEATURE (28)..(28): Xaa stands for Lys, or Lys(Ac)
  MISC_FEATURE (29)..(29): Xaa stands for Gly
  MISC_FEATURE (30)..(30): Xaa stands for Gly
  MISC_FEATURE (39)..(39): Xaa stands for Lys, or Ser
  MISC_FEATURE (40)..(40): Xaa stands for Lys, or a deletion
YXEGTVXXXXXXXXXXXXXXXXXXXXXXXXPSSGAPPPXX

SEQ ID NO: 168 - protein, 40 aa, Artificial Sequence
  Synthetic Peptide (Formula (IV))
  MISC_FEATURE (2)..(2): Xaa stands for Aib
  MISC_FEATURE (6)..(6): Xaa stands for Iva, Phe, or Val
  MISC_FEATURE (7)..(7): Xaa stands for Ile, or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp or Leu
  MISC_FEATURE (10)..(10): Xaa stands for Tyr
  MISC_FEATURE (11)..(11): Xaa stands for Aib or Ser
  MISC_FEATURE (12)..(12): Xaa stands for Ile
  MISC_FEATURE (13)..(13): Xaa stands for Aib, Ala, or D-Iva
  MISC_FEATURE (14)..(14): Xaa stands for Leu
  MISC_FEATURE (15)..(15): Xaa stands for Asp
  MISC_FEATURE (16)..(16): Xaa stands for Arg
  MISC_FEATURE (17)..(17): Xaa stands for Aib, Gln, or Ile
  MISC_FEATURE (18)..(18): Xaa stands for Ala or His
  MISC_FEATURE (19)..(19): Xaa stands for Gln
  MISC_FEATURE (20)..(20): Xaa stands for Aib, Ala, or Gln
  MISC_FEATURE (21)..(21): Xaa stands for Glu, Asn, Asp, or Ser
  MISC_FEATURE (22)..(22): Xaa stands for Phe or alpha-MePhe
  MISC_FEATURE (23)..(23): Xaa stands for Val
  MISC_FEATURE (24)..(24): Xaa stands for Arg, Asp, or Asn
  MISC_FEATURE (25)..(25): Xaa stands for Trp
  MISC_FEATURE (26)..(26): Xaa stands for Leu or Iva
  MISC_FEATURE (27)..(27): Xaa stands for Leu
  MISC_FEATURE (28)..(28): Xaa stands for Ala or Arg
  MISC_FEATURE (29)..(29): Xaa stands for Gln or Gly
  MISC_FEATURE (30)..(30): Xaa stands for Arg or Gly
  MISC_FEATURE (40)..(40): Xaa stands for Arg or a deletion
YXEGTXXXXXXXXXXXXXXXXXXXXXXXXXPSSGAPPPSX

SEQ ID NO: 169 - protein, 40 aa, Artificial Sequence; identical to SEQ ID NO: 165
  Synthetic Peptide (Formula (V))
  MISC_FEATURE (2)..(2): Xaa stands for Aib
  MISC_FEATURE (6)..(6): Xaa stands for Iva, Phe, or Val
  MISC_FEATURE (7)..(7): Xaa stands for Ile, Lys, or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp, Leu, or Phe
  MISC_FEATURE (10)..(10): Xaa stands for Tyr
  MISC_FEATURE (11)..(11): Xaa stands for Aib or Ser
  MISC_FEATURE (12)..(12): Xaa stands for Ile
  MISC_FEATURE (13)..(13): Xaa stands for Aib, Ala, Gln, Leu, Tyr, or D-Iva
  MISC_FEATURE (14)..(14): Xaa stands for Leu
  MISC_FEATURE (15)..(15): Xaa stands for Asp, Glu, Lys, Ser, or Tyr
  MISC_FEATURE (16)..(16): Xaa stands for Arg or Lys
  MISC_FEATURE (17)..(17): Xaa stands for Aib, Gln, or Ile
  MISC_FEATURE (18)..(18): Xaa stands for Ala or His
  MISC_FEATURE (19)..(19): Xaa stands for Gln or Ser
  MISC_FEATURE (21)..(21): Xaa stands for  Asn, Asp, Glu, Leu, or Ser
  MISC_FEATURE (22)..(22): Xaa stands for Phe or alpha-MePhe
  MISC_FEATURE (23)..(23): Xaa stands for Ile or Val
  MISC_FEATURE (24)..(24): Xaa stands for Arg, Asn, Lys, or Lys(Ac)
  MISC_FEATURE (25)..(25): Xaa stands for Trp
  MISC_FEATURE (26)..(26): Xaa stands for Aib, Iva, or Leu
  MISC_FEATURE (27)..(27): Xaa stands for Leu
  MISC_FEATURE (28)..(28): Xaa stands for Ala, Arg, Lys, or Lys(Ac)
  MISC_FEATURE (29)..(29): Xaa stands for Gln or Gly
  MISC_FEATURE (30)..(30): Xaa stands for Arg, Gly or a deletion
  MISC_FEATURE (31)..(40): Xaa stands for a deletion

SEQ ID NO: 170 - protein, 40 aa, Artificial Sequence; identical to SEQ ID NO: 168
  Synthetic Peptide (Formula (VI))
  MISC_FEATURE (2)..(2): Xaa stands for Aib
  MISC_FEATURE (6)..(6): Xaa stands for Iva, Phe, or Val
  MISC_FEATURE (7)..(7): Xaa stands for Ile or Val
  MISC_FEATURE (8)..(30): any one or two amino acids selected from (8) to (30) optionally represent Lys(R), and R represents a substituent group
  MISC_FEATURE (8)..(8): Xaa stands for Ser
  MISC_FEATURE (9)..(9): Xaa stands for Asp or Leu
  MISC_FEATURE (10)..(10): Xaa stands for Tyr
  MISC_FEATURE (11)..(11): Xaa stands for Ser
  MISC_FEATURE (12)..(12): Xaa stands for Ile
  MISC_FEATURE (13)..(13): Xaa stands for Aib or Ala
  MISC_FEATURE (14)..(14): Xaa stands for Leu
  MISC_FEATURE (15)..(15): Xaa stands for Asp
  MISC_FEATURE (16)..(16): Xaa stands for Arg or Lys
  MISC_FEATURE (17)..(17): Xaa stands for Aib, Gln or Ile
  MISC_FEATURE (18)..(18): Xaa stands for Ala or His
  MISC_FEATURE (19)..(19): Xaa stands for Gln
  MISC_FEATURE (20)..(20): Xaa stands for Aib or Gln
  MISC_FEATURE (21)..(21): Xaa stands for Asn, Glu, or Asp
  MISC_FEATURE (22)..(22): Xaa stands for Phe
  MISC_FEATURE (23)..(23): Xaa stands for Val
  MISC_FEATURE (24)..(24): Xaa stands for Arg, Asn, or Lys
  MISC_FEATURE (25)..(25): Xaa stands for Trp
  MISC_FEATURE (26)..(26): Xaa stands for Iva or Leu
  MISC_FEATURE (27)..(27): Xaa stands for Leu
  MISC_FEATURE (28)..(28): Xaa stands for Ala, Arg, or Lys
  MISC_FEATURE (29)..(29): Xaa stands for Gln or Gly
  MISC_FEATURE (30)..(30): Xaa stands for Arg, or Gly
  MISC_FEATURE (40)..(40): Xaa stands for Arg, Lys, or a deletion

SEQ ID NO: 171 - protein, 30 aa, Artificial Sequence
  Synthetic Peptide
  MISC_FEATURE (2)..(2): Xaa stands for Aib
  MISC_FEATURE (12)..(12): Xaa stands for K(PEG(2)-Pal)
  MISC_FEATURE (13)..(13): Xaa stands for Aib
  MISC_FEATURE (20)..(20): Xaa stands for Aib
  MISC_FEATURE (20)..(20): Xaa stands for Aib
YXEGTVVSLYSXXLDKQAQXEFVKWLLAQK

SEQ ID NO: 172 - protein, 30 aa, Artificial Sequence; identical to SEQ ID NO: 171
  Synthetic Peptide
  MISC_FEATURE (2)..(2): Xaa stands for Aib
  MISC_FEATURE (12)..(12): Xaa stands for K(Pal)
  MISC_FEATURE (13)..(13): Xaa stands for Aib
  MISC_FEATURE (20)..(20): Xaa stands for Aib

SEQ ID NO: 173 - protein, 31 aa, Artificial Sequence
  Synthetic Peptide
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (31)..(31): Xaa stands for K(PEG(2)-Pal)
YXEGTVVSLYSIXLDKQAQXEFVKWLLAQKX

SEQ ID NO: 174 - protein, 31 aa, Artificial Sequence; identical to SEQ ID NO: 173
  Synthetic Peptide
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (31)..(31): Xaa stands for K(Pal)

SEQ ID NO: 175 - protein, 30 aa, Artificial Sequence
  Synthetic Peptide
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (30)..(30): Xaa stands for K(PEG(2)-Pal)
YXEGTVVSLYSIXLDKQAQXEFVKWLLKGX

SEQ ID NO: 176 - protein, 30 aa, Artificial Sequence; identical to SEQ ID NO: 175
  Synthetic Peptide
  MISC_FEATURE (2)..(2): Xaa stands for Aib
  MISC_FEATURE (13)..(13): Xaa stands for Aib
  MISC_FEATURE (20)..(20): Xaa stands for Aib
  MISC_FEATURE (30)..(30): Xaa stands for K(Pal)

SEQ ID NO: 177 - protein, 39 aa, Artificial Sequence
  Synthetic Peptide
  MISC_FEATURE (2)..(2): Xaa stands for Aib
  MISC_FEATURE (12)..(12): Xaa stands for K(Pal)
  MISC_FEATURE (13)..(13): Xaa stands for Aib
  MISC_FEATURE (20)..(20): Xaa stands for Aib
YXEGTVVSLYSXXLDRQAQXEFVRWLLRGGPSSGAPPPS

SEQ ID NO: 178 - protein, 39 aa, Artificial Sequence; identical to SEQ ID NO: 177
  Synthetic Peptide
  MISC_FEATURE (2)..(2): Xaa stands for Aib
  MISC_FEATURE (12)..(12): Xaa stands for K(Eda)
  MISC_FEATURE (13)..(13): Xaa stands for Aib
  MISC_FEATURE (20)..(20): Xaa stands for Aib

SEQ ID NO: 179 - protein, 39 aa, Artificial Sequence; identical to SEQ ID NO: 177
  Synthetic Peptide
  MISC_FEATURE (2)..(2): Xaa stands for Aib
  MISC_FEATURE (12)..(12): Xaa stands for K(GGGG-Pal)
  MISC_FEATURE (13)..(13): Xaa stands for Aib
  MISC_FEATURE (20)..(20): Xaa stands for Aib

SEQ ID NO: 180 - protein, 39 aa, Artificial Sequence; identical to SEQ ID NO: 177
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib

SEQ ID NO: 181 - protein, 39 aa, Artificial Sequence
  Synthetic Peptide
  MISC_FEATURE (2)..(2): Xaa stands for Aib
  MISC_FEATURE (12)..(12): Xaa stands for K(Pal)
  MISC_FEATURE (13)..(13): Xaa stands for Aib
  MISC_FEATURE (20)..(20): Xaa stands for Aib
  MISC_FEATURE (24)..(24): Xaa stands for K(Ac)
YXEGTVVSLYSXXLDRQAQXEFVXWLLRGGPSSGAPPPS

SEQ ID NO: 182 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for K(Eda)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 183 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for K(GGGG-Pal)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 184 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 185 - protein, 39 aa, Artificial Sequence
  Synthetic Peptide
  MISC_FEATURE (2)..(2): Xaa stands for Aib
  MISC_FEATURE (12)..(12): Xaa stands for K(PEG(2)-Pal)
YXEGTFISDYSXALDRIHQQDFVNWLLAQRPSSGAPPPS

SEQ ID NO: 186 - protein, 39 aa, Artificial Sequence; identical to SEQ ID NO: 185
  Synthetic Peptide
  MISC_FEATURE (2)..(2): Xaa stands for Aib
  MISC_FEATURE (12)..(12): Xaa stands for K(PEG(2)-Ac)

SEQ ID NO: 187 - protein, 39 aa, Artificial Sequence; identical to SEQ ID NO: 185
  Synthetic Peptide
  MISC_FEATURE (2)..(2): Xaa stands for Aib
  MISC_FEATURE (12)..(12): Xaa stands for K(PEG(2)-hexanoyl)

SEQ ID NO: 188 - protein, 39 aa, Artificial Sequence; identical to SEQ ID NO: 185
  Synthetic Peptide
  MISC_FEATURE (2)..(2): Xaa stands for Aib
  MISC_FEATURE (12)..(12): Xaa stands for K(PEG(2)-dodecanoyl)

SEQ ID NO: 189 - protein, 39 aa, Artificial Sequence; identical to SEQ ID NO: 185
  Synthetic Peptide
  MISC_FEATURE (2)..(2): Xaa stands for Aib
  MISC_FEATURE (12)..(12): Xaa stands for K(PEG(2)-octadecanoyl)

SEQ ID NO: 190 - protein, 40 aa, Artificial Sequence
  Synthetic Peptide
  MISC_FEATURE (2)..(2): Xaa stands for Aib
  MISC_FEATURE (12)..(12): Xaa stands for K(PEG(2)-Pal)
YXEGTFISDYSXALDRIHQQDFVNWLLAQRPSSGAPPPSR

SEQ ID NO: 191 - protein, 40 aa, Artificial Sequence; identical to SEQ ID NO: 190
  Synthetic Peptide
  MISC_FEATURE (2)..(2): Xaa stands for Aib
  MISC_FEATURE (12)..(12): Xaa stands for K(PEG(2)-Ac)

SEQ ID NO: 192 - protein, 40 aa, Artificial Sequence; identical to SEQ ID NO: 190
  Synthetic Peptide
  MISC_FEATURE (2)..(2): Xaa stands for Aib
  MISC_FEATURE (12)..(12): Xaa stands for K(PEG(2)-hexanoyl)

SEQ ID NO: 193 - protein, 40 aa, Artificial Sequence; identical to SEQ ID NO: 190
  Synthetic Peptide
  MISC_FEATURE (2)..(2): Xaa stands for Aib
  MISC_FEATURE (12)..(12): Xaa stands for K(PEG(2)-dodecanoyl)

SEQ ID NO: 194 - protein, 40 aa, Artificial Sequence; identical to SEQ ID NO: 190
  Synthetic Peptide
  MISC_FEATURE (2)..(2): Xaa stands for Aib
  MISC_FEATURE (12)..(12): Xaa stands for K(PEG(2)-octadecanoyl)

SEQ ID NO: 195 - protein, 40 aa, Artificial Sequence
  Synthetic Peptide
  MISC_FEATURE (2)..(2): Xaa stands for Aib
  MISC_FEATURE (12)..(12): Xaa stands for K(PEG(2)-decanoyl)
YXEGTFISDYSXALDRIAQQDFVNWLLAQRPSSGAPPPSR

SEQ ID NO: 196 - protein, 40 aa, Artificial Sequence; identical to SEQ ID NO: 195
  Synthetic Peptide
  MISC_FEATURE (2)..(2): Xaa stands for Aib
  MISC_FEATURE (12)..(12): Xaa stands for K(PEG(2)-undecanoyl)

SEQ ID NO: 197 - protein, 40 aa, Artificial Sequence; identical to SEQ ID NO: 195
  Synthetic Peptide
  MISC_FEATURE (2)..(2): Xaa stands for Aib
  MISC_FEATURE (12)..(12): Xaa stands for K(PEG(2)-dodecanoyl)

SEQ ID NO: 198 - protein, 40 aa, Artificial Sequence; identical to SEQ ID NO: 195
  Synthetic Peptide
  MISC_FEATURE (2)..(2): Xaa stands for Aib
  MISC_FEATURE (12)..(12): Xaa stands for K(PEG(2)-tridecanoyl)

SEQ ID NO: 199 - protein, 40 aa, Artificial Sequence; identical to SEQ ID NO: 195
  Synthetic Peptide
  MISC_FEATURE (2)..(2): Xaa stands for Aib
  MISC_FEATURE (12)..(12): Xaa stands for K(PEG(2)-tetradecanoyl)

SEQ ID NO: 200 - protein, 40 aa, Artificial Sequence; identical to SEQ ID NO: 195
  Synthetic Peptide
  MISC_FEATURE (2)..(2): Xaa stands for Aib
  MISC_FEATURE (12)..(12): Xaa stands for K(PEG(2)-pentadecanoyl)

SEQ ID NO: 201 - protein, 40 aa, Artificial Sequence; identical to SEQ ID NO: 195
  Synthetic Peptide
  MISC_FEATURE (2)..(2): Xaa stands for Aib
  MISC_FEATURE (12)..(12): Xaa stands for K(PEG(2)-Dda)

SEQ ID NO: 202 - protein, 40 aa, Artificial Sequence; identical to SEQ ID NO: 195
  Synthetic Peptide
  MISC_FEATURE (2)..(2): Xaa stands for Aib
  MISC_FEATURE (12)..(12): Xaa stands for K(PEG(4)-dodecanoyl)

SEQ ID NO: 203 - protein, 40 aa, Artificial Sequence; identical to SEQ ID NO: 195
  Synthetic Peptide
  MISC_FEATURE (2)..(2): Xaa stands for Aib
  MISC_FEATURE (12)..(12): Xaa stands for K(PEG(4)-Pal)

SEQ ID NO: 204 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
YXEGTFISDYSXALDRIAQQDFVNWLLAQRPSSGAPPPS

SEQ ID NO: 205 - protein, 39 aa, Artificial Sequence; identical to SEQ ID NO: 204
  Synthetic Peptide
  MISC_FEATURE (2)..(2): Xaa stands for Aib
  MISC_FEATURE (12)..(12): Xaa stands for Lys(Dodecanoyl-PEG(2)-)

SEQ ID NO: 206 - protein, 40 aa, Artificial Sequence
  Synthetic peptide
  MISC_FEATURE (2)..(2): Xaa stands for Aib
  MISC_FEATURE (12)..(12): Xaa stands for Lys(Dodecanoyl-PEG(2)-)
  MISC_FEATURE (26)..(26): Xaa stands for Iva
YXEGTFISDYSXALDRIAQQDFVNWXLAQRPSSGAPPPSR

SEQ ID NO: 207 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (25)..(25): Xaa stands for alpha-MeF
YXEGTFISDYSXALDRIAQQDFVNXLLAQRPSSGAPPPSR

SEQ ID NO: 208 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
YXEGTFISDYSXALDRIAQQDXVNWLLAQRPSSGAPPPSR

SEQ ID NO: 209 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
YXEGTFISDYSXALDRIAQQSFVNWLLAQRPSSGAPPPSR

SEQ ID NO: 210 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
YXEGTFISDYSXALDRIAQXNFVNWLLAQRPSSGAPPPSR

SEQ ID NO: 211 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
YXEGTFISDYSXALDRXAQQDFVNWLLAQRPSSGAPPPSR

SEQ ID NO: 212 - protein, 40 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (13)..(13): Xaa stands for DIva
YXEGTFISDYSXXLDRIAQQDFVNWLLAQRPSSGAPPPSR

SEQ ID NO: 213 - protein, 40 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
YXEGTXISDYSXALDRIAQQDFVNWLLAQRPSSGAPPPSR

SEQ ID NO: 214 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (26)..(26): Xaa stands for Iva
YXEGTFISDYSXALDRIAQQDFVNWXLAQRPSSGAPPPS

SEQ ID NO: 215 - protein, 39 aa, Artificial Sequence
  Synthetic peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
YXEGTFISDYSXALDRIAQQDXVNWLLAQRPSSGAPPPS

SEQ ID NO: 216 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
YXEGTFISDYSXALDRIAQQSFVNWLLAQRPSSGAPPPS

SEQ ID NO: 217 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
YXEGTFISDYSXALDRIAQXNFVNWLLAQRPSSGAPPPS

SEQ ID NO: 218 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
YXEGTFISDYSXALDRXAQQDFVNWLLAQRPSSGAPPPS

SEQ ID NO: 219 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (13)..(13): Xaa stands for DIva
YXEGTFISDYSXXLDRIAQQDFVNWLLAQRPSSGAPPPS

SEQ ID NO: 220 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
YXEGTXISDYSXALDRIAQQDFVNWLLAQRPSSGAPPPS

SEQ ID NO: 221 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
YXEGTFISDYSXALDRIHQQDXVNWLLAQRPSSGAPPPS

SEQ ID NO: 222 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
YXEGTFISDYSXALDRIHQXNFVNWLLAQRPSSGAPPPS

SEQ ID NO: 223 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
YXEGTFISDYSXALDRXHQQDFVNWLLAQRPSSGAPPPS

SEQ ID NO: 224 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSXALDRXAQXNFVNWXLAQRPSSGAPPPS

SEQ ID NO: 225 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
  MISC_FEATURE (22)..(22): Xaa stands for alpha-MeF
  misc_feature (26)..(26): Xaa can be any naturally occurring amino acid
YXEGTFISDYSXALDRIAQXNXVNWXLAQRPSSGAPPPS

SEQ ID NO: 226 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (22)..(22): Xaa stands for alpha-MeF
YXEGTFISDYSXALDRXAQQDXVNWLLAQRPSSGAPPPS

SEQ ID NO: 227 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
YXEGTXISDYSXALDRXAQXNFVNWLLAQRPSSGAPPPS

SEQ ID NO: 228 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSXALDRXHQXNFVNWXLAQRPSSGAPPPS

SEQ ID NO: 229 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (20)..(20): Xaa stands for Aib
  MISC_FEATURE (22)..(22): Xaa stands for alpha-MeF
  MISC_FEATURE (26)..(26): Xaa stands for Iva
YXEGTFISDYSXALDRIHQXNXVNWXLAQRPSSGAPPPS

SEQ ID NO: 230 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (22)..(22): Xaa stands for alpha-MeF
YXEGTFISDYSXALDRXHQQDXVNWLLAQRPSSGAPPPS

SEQ ID NO: 231 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
YXEGTXISDYSXALDRXHQXNFVNWLLAQRPSSGAPPPS

SEQ ID NO: 232 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dodecanoyl-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXALDRXHQXNFVNWXLAQRPSSGAPPPS

SEQ ID NO: 233 - protein, 39 aa, Artificial Sequence
  Synthetic peptide
  MISC_FEATURE (2)..(2): Xaa stands for Aib
  MISC_FEATURE (12)..(12): Xaa stands for Lys(Dodecanoyl-PEG(2)-)
  MISC_FEATURE (26)..(26): Xaa stands for Iva
YXEGTFISDYSXALDRIAQQSFVNWXLAQRPSSGAPPPS

SEQ ID NO: 234 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
  MISC_FEATURE (26)..(26): Xaa stands for Iva
YXEGTFISDYSXALDRIAQQSXVNWXLAQRPSSGAPPPS

SEQ ID NO: 235 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (26)..(26): Xaa stands for Iva
YXEGTFISDYSXALDRIHQQSFVNWXLAQRPSSGAPPPS

SEQ ID NO: 236 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (22)..(22): Xaa stands for alpha-MeF
  MISC_FEATURE (26)..(26): Xaa stands for Iva
YXEGTFISDYSXALDRIHQQSXVNWXLAQRPSSGAPPPS

SEQ ID NO: 237 - protein, 39 aa, Artificial Sequence
  Synthetic Peptide
  MISC_FEATURE (2)..(2): Xaa stands for Aib
  MISC_FEATURE (12)..(12): Xaa stands for Lys(Dodecanoyl-PEG(2)-)
  MISC_FEATURE (17)..(17): Xaa stands for Aib
  MISC_FEATURE (26)..(26): Xaa stands for Iva
YXEGTFISDYSXALDRXHQQSFVNWXLAQRPSSGAPPPS

SEQ ID NO: 238 - protein, 39 aa, Artificial Sequence; identical to SEQ ID NO: 185
  Synthetic Peptide
  MISC_FEATURE (2)..(2): Xaa stands for Aib
  MISC_FEATURE (12)..(12): Xaa stands for C(1S2S-11NC-acetyl)

SEQ ID NO: 239 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(PEG(2)-dodec)
  MISC_FEATURE (20)..(20): Xaa stands for Aib
  MISC_FEATURE (26)..(26): Xaa stands for Iva
YXEGTXISDYSIXLDRXAQXNFVNWXLAQRPSSGAPPPS

SEQ ID NO: 240 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(PEG(2)-Pal)
  MISC_FEATURE (20)..(20): Xaa stands for Aib
  MISC_FEATURE (26)..(26): Xaa stands for Iva

SEQ ID NO: 241 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-) .
  MISC_FEATURE (20)..(20): Xaa stands for Aib
  MISC_FEATURE (26)..(26): Xaa stands for Iva

SEQ ID NO: 242 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for K(PEG(2)-dodec)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVNWXLAQRPSSGAPPPS

SEQ ID NO: 243 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for K(PEG(2)-Pal)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 244 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 245 - protein, 39 aa, Artificial Sequence
  Synthetic Peptide
  MISC_FEATURE (2)..(2): Xaa stands for Aib
  MISC_FEATURE (17)..(17): Xaa stands for K(PEG(2)-dodec)
YXEGTFISDYSIALDRXHQQDFVNWLLAQRPSSGAPPPS

SEQ ID NO: 246 - protein, 39 aa, Artificial Sequence; identical to SEQ ID NO: 245
  Synthetic Peptide
  MISC_FEATURE (2)..(2): Xaa stands for Aib
  MISC_FEATURE (17)..(17): Xaa stands for K(PEG(2)-Pal)

SEQ ID NO: 247 - protein, 39 aa, Artificial Sequence; identical to SEQ ID NO: 245
  Synthetic Peptide
  MISC_FEATURE (2)..(2): Xaa stands for Aib
  MISC_FEATURE (17)..(17): Xaa stands for Lys(Eda-PEG(2)-) .

SEQ ID NO: 248 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-PEG3-PEG3-isoGlu-Eda)
  MISC_FEATURE (20)..(20): Xaa stands for Aib
  MISC_FEATURE (26)..(26): Xaa stands for Iva

SEQ ID NO: 249 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for K(-PEG3-PEG3-isoGlu-Eda)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 250 - protein, 39 aa, Artificial Sequence; identical to SEQ ID NO: 245
  Synthetic Peptide
  MISC_FEATURE (2)..(2): Xaa stands for Aib
  MISC_FEATURE (17)..(17): Xaa stands for K(-PEG3-PEG3-isoGlu-Eda)

SEQ ID NO: 251 - protein, 39 aa, Artificial Sequence; identical to SEQ ID NO: 185
  Synthetic Peptide
  MISC_FEATURE (2)..(2): Xaa stands for Aib
  MISC_FEATURE (12)..(12): Xaa stands for K(-PEG3-PEG3-isoGlu-Eda)

SEQ ID NO: 252 - protein, 39 aa, Artificial Sequence
  Synthetic Peptide
  MISC_FEATURE (2)..(2): Xaa stands for Aib
  MISC_FEATURE (17)..(17): Xaa stands for K(PEG(2)-dodec)
  MISC_FEATURE (20)..(20): Xaa stands for Aib
  MISC_FEATURE (26)..(26): Xaa stands for Iva
YXEGTFISDYSIALDRXHQXNFVNWXLAQRPSSGAPPPS

SEQ ID NO: 253 - protein, 39 aa, Artificial Sequence; identical to SEQ ID NO: 252
  Synthetic Peptide
  MISC_FEATURE (2)..(2): Xaa stands for Aib
  MISC_FEATURE (17)..(17): Xaa stands for K(PEG(2)-Pal)
  MISC_FEATURE (20)..(20): Xaa stands for Aib
  MISC_FEATURE (26)..(26): Xaa stands for Iva

SEQ ID NO: 254 - protein, 39 aa, Artificial Sequence; identical to SEQ ID NO: 252
  Synthetic Peptide
  MISC_FEATURE (2)..(2): Xaa stands for Aib
  MISC_FEATURE (17)..(17): Xaa stands for Lys(Eda-PEG(2)-) .
  misc_feature (20)..(20): Xaa can be any naturally occurring amino acid
  MISC_FEATURE (26)..(26): Xaa stands for Iva

SEQ ID NO: 255 - protein, 39 aa, Artificial Sequence; identical to SEQ ID NO: 228
  Synthetic Peptide
  MISC_FEATURE (2)..(2): Xaa stands for Aib
  MISC_FEATURE (12)..(12): Xaa stands for K(-PEG3-PEG3-isoGlu-Eda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 256 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Ac--) .
  MISC_FEATURE (20)..(20): Xaa stands for Aib
  MISC_FEATURE (26)..(26): Xaa stands for Iva
YXEGTXISDYSIXLDRXHQXNFVNWXLAQRPSSGAPPPS

SEQ ID NO: 257 - protein, 39 aa, Artificial Sequence; identical to SEQ ID NO: 177
  Synthetic Peptide
  MISC_FEATURE (2)..(2): Xaa stands for Aib
  MISC_FEATURE (12)..(12): Xaa stands for Lys(Eda-PEG(2)-)
  MISC_FEATURE (13)..(13): Xaa stands for Aib
  MISC_FEATURE (20)..(20): Xaa stands for Aib

SEQ ID NO: 258 - protein, 39 aa, Artificial Sequence; identical to SEQ ID NO: 177
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib

SEQ ID NO: 259 - protein, 39 aa, Artificial Sequence; identical to SEQ ID NO: 177
  Synthetic Peptide
  MISC_FEATURE (2)..(2): Xaa stands for Aib
  MISC_FEATURE (12)..(12): Xaa stands for Lys(Eicosanoyl-GGGG-)
  MISC_FEATURE (13)..(13): Xaa stands for Aib
  MISC_FEATURE (20)..(20): Xaa stands for Aib

SEQ ID NO: 260 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for Lys(Eda-PEG(2)-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 261 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 262 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for Lys(Eicosanoyl-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 263 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 264 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eicosanoyl-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 265 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 266 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGG-)
  MISC_FEATURE (20)..(20): Xaa stands for Aib
  MISC_FEATURE (26)..(26): Xaa stands for Iva

SEQ ID NO: 267 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eicosanoyl-PEG(2)-) .
  MISC_FEATURE (20)..(20): Xaa stands for Aib
  MISC_FEATURE (26)..(26): Xaa stands for Iva

SEQ ID NO: 268 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-) .
  MISC_FEATURE (20)..(20): Xaa stands for Aib
  MISC_FEATURE (26)..(26): Xaa stands for Iva

SEQ ID NO: 269 - protein, 30 aa, Artificial Sequence
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
YXEGTVVSLYSXXLDRQAQXEFVRWLLAQR

SEQ ID NO: 270 - protein, 30 aa, Artificial Sequence; identical to SEQ ID NO: 269
  Synthetic Peptide
  MISC_FEATURE (2)..(2): Xaa stands for Aib
  MISC_FEATURE (12)..(12): Xaa stands for Lys(Octadecanoyl-GGGG-)
  MISC_FEATURE (13)..(13): Xaa stands for Aib
  MISC_FEATURE (20)..(20): Xaa stands for Aib

SEQ ID NO: 271 - protein, 30 aa, Artificial Sequence; identical to SEQ ID NO: 269
  Synthetic Peptide
  MISC_FEATURE (2)..(2): Xaa stands for Aib
  MISC_FEATURE (12)..(12): Xaa stands for Lys(Octadecanoyl-GGGG-)
  MISC_FEATURE (13)..(13): Xaa stands for Aib
  MISC_FEATURE (20)..(20): Xaa stands for Aib

SEQ ID NO: 272 - protein, 30 aa, Artificial Sequence
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)
YXEGTVVSLYSXXLDRQAQXEFVXWLLAQR

SEQ ID NO: 273 - protein, 30 aa, Artificial Sequence; identical to SEQ ID NO: 272
  Synthetic Peptide
  MISC_FEATURE (2)..(2): Xaa stands for Aib
  MISC_FEATURE (12)..(12): Xaa stands for Lys(Eda-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 274 - protein, 30 aa, Artificial Sequence; identical to SEQ ID NO: 272
  Synthetic Peptide
  MISC_FEATURE (2)..(2): Xaa stands for Aib
  MISC_FEATURE (12)..(12): Xaa stands for Lys(Octadecanoyl-GGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 275 - protein, 30 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVNWXLAQR

SEQ ID NO: 276 - protein, 30 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXHQXNFVNWXLAQR

SEQ ID NO: 277 - protein, 30 aa, Artificial Sequence; identical to SEQ ID NO: 275
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 278 - protein, 30 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Lys(Eda-PEG(2)-) .
  MISC_FEATURE (20)..(20): Xaa stands for Aib
  MISC_FEATURE (26)..(26): Xaa stands for Iva
YXEGTXISDYSIXLDRXAQXNFVNWXLAQR

SEQ ID NO: 279 - protein, 30 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva
YXEGTXISDYSIXLDRXHQXNFVNWXLAQR

SEQ ID NO: 280 - protein, 40 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVNWXLAQRPSSGAPPPSE

SEQ ID NO: 281 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVDWXLAQRPSSGAPPPS

SEQ ID NO: 282 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAQXNFVEWXLAQRPSSGAPPPS

SEQ ID NO: 283 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXXLDRXAEXNFVNWXLAQRPSSGAPPPS

SEQ ID NO: 284 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSXELDRXAQXNFVNWXLAQRPSSGAPPPS

SEQ ID NO: 285 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYEXXLDRXAQXNFVNWXLAQRPSSGAPPPS

SEQ ID NO: 286 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGEXISDYSXXLDRXAQXNFVNWXLAQRPSSGAPPPS

SEQ ID NO: 287 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva
YXEGTXISDYSEXLDRXAQXNFVNWXLAQRPSSGAPPPS

SEQ ID NO: 288 - protein, 40 aa, Artificial Sequence; identical to SEQ ID NO: 280
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda- - -)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 289 - protein, 40 aa, Artificial Sequence; identical to SEQ ID NO: 280
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 290 - protein, 40 aa, Artificial Sequence; identical to SEQ ID NO: 280
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 291 - protein, 40 aa, Artificial Sequence; identical to SEQ ID NO: 280
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 292 - protein, 40 aa, Artificial Sequence; identical to SEQ ID NO: 280
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)4-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 293 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda- - -)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 294 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-G-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 295 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 296 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 297 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 298 - protein, 39 aa, Artificial Sequence
  Synthetic Peptide
  MISC_FEATURE (2)..(2): Xaa stands for Aib
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (24)..(24): Xaa stands for K(Ac)
YXEGTVVSLYSIXLDRXAQXEFVXWLLRGGPSSGAPPPS

SEQ ID NO: 299 - protein, 39 aa, Artificial Sequence; identical to SEQ ID NO: 298
  Synthetic Peptide
  MISC_FEATURE (2)..(2): Xaa stands for Aib
  MISC_FEATURE (13)..(13): Xaa stands for Aib
  MISC_FEATURE (17)..(17): Xaa stands for Lys(Eda-GGGG-)
  MISC_FEATURE (20)..(20): Xaa stands for Aib
  MISC_FEATURE (24)..(24): Xaa stands for K(Ac)

SEQ ID NO: 300 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (8)..(8): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXIXDYSIXLDRXAQXNFVNWXLAQRPSSGAPPPS

SEQ ID NO: 301 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (9)..(9): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISXYSIXLDRXAQXNFVNWXLAQRPSSGAPPPS

SEQ ID NO: 302 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (10)..(10): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDXSIXLDRXAQXNFVNWXLAQRPSSGAPPPS

SEQ ID NO: 303 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (11)..(11): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYXIXLDRXAQXNFVNWXLAQRPSSGAPPPS

SEQ ID NO: 304 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 305 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQRPSSGAPPPS

SEQ ID NO: 306 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (15)..(15): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXLXRXAQXNFVNWXLAQRPSSGAPPPS

SEQ ID NO: 307 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (16)..(16): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXLDXXAQXNFVNWXLAQRPSSGAPPPS

SEQ ID NO: 308 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (18)..(18): Xaa stands for Lys(Eda-PEG(2)-)
  MISC_FEATURE (20)..(20): Xaa stands for Aib
  MISC_FEATURE (26)..(26): Xaa stands for Iva
YXEGTXISDYSIXLDRXXQXNFVNWXLAQRPSSGAPPPS

SEQ ID NO: 309 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (19)..(19): Xaa stands for Lys(Eda-PEG(2)-)
  MISC_FEATURE (20)..(20): Xaa stands for Aib
  MISC_FEATURE (26)..(26): Xaa stands for Iva
YXEGTXISDYSIXLDRXAXXNFVNWXLAQRPSSGAPPPS

SEQ ID NO: 310 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Lys(Eda-PEG(2)-)
  MISC_FEATURE (26)..(26): Xaa stands for Iva

SEQ ID NO: 311 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (21)..(21): Xaa stands for Lys(Eda-PEG(2)-)
  MISC_FEATURE (26)..(26): Xaa stands for Iva
YXEGTXISDYSIXLDRXAQXXFVNWXLAQRPSSGAPPPS

SEQ ID NO: 312 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (22)..(22): Xaa stands for Lys(Eda-PEG(2)-)
  MISC_FEATURE (26)..(26): Xaa stands for Iva
YXEGTXISDYSIXLDRXAQXNXVNWXLAQRPSSGAPPPS

SEQ ID NO: 313 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (23)..(23): Xaa stands for Lys(Eda-PEG(2)-)
  MISC_FEATURE (26)..(26): Xaa stands for Iva
YXEGTXISDYSIXLDRXAQXNFXNWXLAQRPSSGAPPPS

SEQ ID NO: 314 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (24)..(24): Xaa stands for Lys(Eda-PEG(2)-)
  MISC_FEATURE (26)..(26): Xaa stands for Iva
YXEGTXISDYSIXLDRXAQXNFVXWXLAQRPSSGAPPPS

SEQ ID NO: 315 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (25)..(25): Xaa stands for Lys(Eda-PEG(2)-)
  MISC_FEATURE (26)..(26): Xaa stands for Iva
YXEGTXISDYSIXLDRXAQXNFVNXXLAQRPSSGAPPPS

SEQ ID NO: 316 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Lys(Eda-PEG(2)-)

SEQ ID NO: 317 - protein, 39 aa, Artificial Sequence
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (27)..(27): Xaa stands for Lys(Eda-PEG(2)-)
YXEGTXISDYSIXLDRXAQXNFVNWXXAQRPSSGAPPPS

SEQ ID NO: 318 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda- - -)
  MISC_FEATURE (20)..(20): Xaa stands for Aib
  MISC_FEATURE (26)..(26): Xaa stands for Iva

SEQ ID NO: 319 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG3-)
  MISC_FEATURE (20)..(20): Xaa stands for Aib
  MISC_FEATURE (26)..(26): Xaa stands for Iva

SEQ ID NO: 320 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)2-)
  MISC_FEATURE (20)..(20): Xaa stands for Aib
  MISC_FEATURE (26)..(26): Xaa stands for Iva

SEQ ID NO: 321 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)3-)
  MISC_FEATURE (20)..(20): Xaa stands for Aib
  MISC_FEATURE (26)..(26): Xaa stands for Iva

SEQ ID NO: 322 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)4-)
  MISC_FEATURE (20)..(20): Xaa stands for Aib
  MISC_FEATURE (26)..(26): Xaa stands for Iva

SEQ ID NO: 323 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)5-)
  MISC_FEATURE (20)..(20): Xaa stands for Aib
  MISC_FEATURE (26)..(26): Xaa stands for Iva

SEQ ID NO: 324 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-G-)
  MISC_FEATURE (20)..(20): Xaa stands for Aib
  MISC_FEATURE (26)..(26): Xaa stands for Iva

SEQ ID NO: 325 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GG-)
  MISC_FEATURE (20)..(20): Xaa stands for Aib
  MISC_FEATURE (26)..(26): Xaa stands for Iva

SEQ ID NO: 326 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGG-)
  MISC_FEATURE (20)..(20): Xaa stands for Aib
  MISC_FEATURE (26)..(26): Xaa stands for Iva

SEQ ID NO: 327 - protein, 39 aa, Artificial Sequence; identical to SEQ ID NO: 239
  Synthetic Peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 328 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-Glu-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 329 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 330 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(gamma-E)2-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 331 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(gamma-Glu)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 332 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(gamma-Glu)3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 333 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-GGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 334 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GABA-GGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 335 - protein, 39 aa, Artificial Sequence; identical to SEQ ID NO: 242
  Synthetic Peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GABA-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 336 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for Lys(Eda-PEG3-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 337 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for Lys(Eda-PEG3-PEG3-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 338 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for Lys(Eda-gamma-E-PEG3-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 339 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for Lys(Eda-gamma-E-(PEG3)2-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 340 - protein, 39 aa, Artificial Sequence; identical to SEQ ID NO: 181
  Synthetic Peptide
  MISC_FEATURE (2)..(2): Xaa stands for Aib
  MISC_FEATURE (12)..(12): Xaa stands for Lys(Eda-GGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 341 - protein, 39 aa, Artificial Sequence; identical to SEQ ID NO: 181
  Synthetic peptide
  MISC_FEATURE (2)..(2): Xaa stands for Aib
  MISC_FEATURE (12)..(12): Xaa stands for Lys(Eda-gamma-Glu-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 342 - protein, 39 aa, Artificial Sequence; identical to SEQ ID NO: 181
  Synthetic peptide
  MISC_FEATURE (2)..(2): Xaa stands for Aib
  MISC_FEATURE (12)..(12): Xaa stands for Lys(Eda-gamma-E-GGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 343 - protein, 39 aa, Artificial Sequence; identical to SEQ ID NO: 181
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (13)..(13): Xaa stands for Aib
  MISC_FEATURE (20)..(20): Xaa stands for Aib
  MISC_FEATURE (24)..(24): Xaa stands for K(Ac)

SEQ ID NO: 344 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 345 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 346 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 347 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-Tra-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 348 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-Lys-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 349 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-NpipAc-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 350 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-AMBZ-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 351 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-Tra-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 352 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-AMBZ-PEG3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 353 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 354 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 355 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 356 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Oda-GGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 357 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Oda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 358 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Oda-gamma-E-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 359 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Oda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 360 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 361 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Oda-GGGG-)
  MISC_FEATURE (20)..(20): Xaa stands for Aib
  MISC_FEATURE (26)..(26): Xaa stands for Iva

SEQ ID NO: 362 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Oda-GGGGG-)
  MISC_FEATURE (20)..(20): Xaa stands for Aib
  MISC_FEATURE (26)..(26): Xaa stands for Iva

SEQ ID NO: 363 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Oda-gamma-E-(PEG3)2-)
  MISC_FEATURE (20)..(20): Xaa stands for Aib
  MISC_FEATURE (26)..(26): Xaa stands for Iva

SEQ ID NO: 364 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Oda-PEG(2)-)
  MISC_FEATURE (20)..(20): Xaa stands for Aib
  MISC_FEATURE (26)..(26): Xaa stands for Iva

SEQ ID NO: 365 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGGG-)
  MISC_FEATURE (20)..(20): Xaa stands for Aib
  MISC_FEATURE (26)..(26): Xaa stands for Iva

SEQ ID NO: 366 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-Tra-GGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 367 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-G9-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Aib

SEQ ID NO: 368 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Dda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 369 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-epsilon-Lys-GGG-)
  MISC_FEATURE (13)..(13): Xaa stands for Aib
  MISC_FEATURE (17)..(17): Xaa stands for Aib
  misc_feature (20)..(20): Xaa can be any naturally occurring amino acid
  MISC_FEATURE (26)..(26): Xaa stands for Iva

SEQ ID NO: 370 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-gamma-E-GGG-)
  MISC_FEATURE (20)..(20): Xaa stands for Aib
  MISC_FEATURE (26)..(26): Xaa stands for Iva

SEQ ID NO: 371 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GABA-GGG-)
  MISC_FEATURE (20)..(20): Xaa stands for Aib
  MISC_FEATURE (26)..(26): Xaa stands for Iva

SEQ ID NO: 372 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-epsilon-Lys-GGG-)
  MISC_FEATURE (20)..(20): Xaa stands for Aib
  MISC_FEATURE (26)..(26): Xaa stands for Iva

SEQ ID NO: 373 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-Tra-GGG-)
  MISC_FEATURE (20)..(20): Xaa stands for Aib
  MISC_FEATURE (26)..(26): Xaa stands for Iva

SEQ ID NO: 374 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Dda-GGGGG-)
  MISC_FEATURE (20)..(20): Xaa stands for Aib
  MISC_FEATURE (26)..(26): Xaa stands for Iva

SEQ ID NO: 375 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-G9-)
  MISC_FEATURE (20)..(20): Xaa stands for Aib
  MISC_FEATURE (26)..(26): Xaa stands for Iva

SEQ ID NO: 376 - protein, 30 aa, Artificial Sequence; identical to SEQ ID NO: 275
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 377 - protein, 30 aa, Artificial Sequence; identical to SEQ ID NO: 275
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 378 - protein, 30 aa, Artificial Sequence; identical to SEQ ID NO: 275
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 379 - protein, 30 aa, Artificial Sequence; identical to SEQ ID NO: 275
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-(PEG3)3-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 380 - protein, 30 aa, Artificial Sequence; identical to SEQ ID NO: 275
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-gamma-E-(PEG3)2-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 381 - protein, 30 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQR

SEQ ID NO: 382 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 383 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 384 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-(PEG3)2-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 385 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-gamma-E-(PEG3)2-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 386 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-(PEG3)3-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 387 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGG-)
  MISC_FEATURE (20)..(20): Xaa stands for Aib
  MISC_FEATURE (26)..(26): Xaa stands for Iva

SEQ ID NO: 388 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 389 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGGG-)
  MISC_FEATURE (20)..(20): Xaa stands for Aib
  MISC_FEATURE (26)..(26): Xaa stands for Iva

SEQ ID NO: 390 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)2-)
  MISC_FEATURE (20)..(20): Xaa stands for Aib
  MISC_FEATURE (26)..(26): Xaa stands for Iva

SEQ ID NO: 391 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-gamma-E-(PEG3)2-) .
  MISC_FEATURE (20)..(20): Xaa stands for Aib
  MISC_FEATURE (26)..(26): Xaa stands for Iva

SEQ ID NO: 392 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-(PEG3)3-)
  MISC_FEATURE (20)..(20): Xaa stands for Aib
  MISC_FEATURE (26)..(26): Xaa stands for Iva

SEQ ID NO: 393 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 394 - protein, 39 aa, Artificial Sequence
  Synthetic peptide
  MISC_FEATURE (2)..(2): Xaa stands for Aib
  MISC_FEATURE (12)..(12): Xaa stands for Lys(Eda-PEG(2)-)
  MISC_FEATURE (26)..(26): Xaa stands for Iva
YXEGTFISDYSXALDRIAQQNFVNWXLAQRPSSGAPPPS

SEQ ID NO: 395 - protein, 39 aa, Artificial Sequence; identical to SEQ ID NO: 394
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (26)..(26): Xaa stands for Iva

SEQ ID NO: 396 - protein, 39 aa, Artificial Sequence
  Synthetic peptide
  MISC_FEATURE (2)..(2): Xaa stands for Aib
  MISC_FEATURE (14)..(14): Xaa stands for Lys(Eda-PEG(2)-)
  MISC_FEATURE (26)..(26): Xaa stands for Iva
YXEGTFISDYSIAXDRIAQQNFVNWXLAQRPSSGAPPPS

SEQ ID NO: 397 - protein, 39 aa, Artificial Sequence; identical to SEQ ID NO: 396
  Synthetic peptide
  MISC_FEATURE (2)..(2): Xaa stands for Aib
  MISC_FEATURE (14)..(14): Xaa stands for Lys(Eda-GGGGG-)
  MISC_FEATURE (26)..(26): Xaa stands for Iva

SEQ ID NO: 398 - protein, 39 aa, Artificial Sequence
  Synthetic peptide
  MISC_FEATURE (2)..(2): Xaa stands for Aib
  MISC_FEATURE (17)..(17): Xaa stands for Lys(Eda-PEG(2)-)
  MISC_FEATURE (26)..(26): Xaa stands for Iva
YXEGTFISDYSIALDRXAQQNFVNWXLAQRPSSGAPPPS

SEQ ID NO: 399 - protein, 39 aa, Artificial Sequence; identical to SEQ ID NO: 398
  Synthetic peptide
  MISC_FEATURE (2)..(2): Xaa stands for Aib
  MISC_FEATURE (17)..(17): Xaa stands for Lys(Eda-GGGGG-)
  MISC_FEATURE (26)..(26): Xaa stands for Iva

SEQ ID NO: 400 - protein, 30 aa, Artificial Sequence
  Synthetic peptide
  MISC_FEATURE (2)..(2): Xaa stands for Aib
  MISC_FEATURE (12)..(12): Xaa stands for Lys(Eda-PEG(2)-)
  MISC_FEATURE (26)..(26): Xaa stands for Iva
YXEGTFISDYSXALDRIAQQNFVNWXLAQR

SEQ ID NO: 401 - protein, 30 aa, Artificial Sequence; identical to SEQ ID NO: 400
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (26)..(26): Xaa stands for Iva

SEQ ID NO: 402 - protein, 30 aa, Artificial Sequence
  Synthetic peptide
  MISC_FEATURE (2)..(2): Xaa stands for Aib
  MISC_FEATURE (14)..(14): Xaa stands for Lys(Eda-PEG(2)-)
  MISC_FEATURE (26)..(26): Xaa stands for Iva
YXEGTFISDYSIAXDRIAQQNFVNWXLAQR

SEQ ID NO: 403 - protein, 30 aa, Artificial Sequence; identical to SEQ ID NO: 402
  Synthetic peptide
  MISC_FEATURE (2)..(2): Xaa stands for Aib
  MISC_FEATURE (14)..(14): Xaa stands for Lys(Eda-GGGGG-)
  MISC_FEATURE (26)..(26): Xaa stands for Iva

SEQ ID NO: 404 - protein, 30 aa, Artificial Sequence
  Synthetic peptide
  MISC_FEATURE (2)..(2): Xaa stands for Aib
  MISC_FEATURE (17)..(17): Xaa stands for Lys(Eda-PEG(2)-)
  MISC_FEATURE (26)..(26): Xaa stands for Iva
YXEGTFISDYSIALDRXAQQNFVNWXLAQR

SEQ ID NO: 405 - protein, 30 aa, Artificial Sequence; identical to SEQ ID NO: 404
  Synthetic peptide
  MISC_FEATURE (2)..(2): Xaa stands for Aib
  MISC_FEATURE (17)..(17): Xaa stands for Lys(Eda-GGGGG-)
  MISC_FEATURE (26)..(26): Xaa stands for Iva

SEQ ID NO: 406 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 407 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 408 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 409 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva

SEQ ID NO: 410 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 411 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 412 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 413 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva

SEQ ID NO: 414 - protein, 39 aa, Artificial Sequence; identical to SEQ ID NO: 394
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (26)..(26): Xaa stands for Iva

SEQ ID NO: 415 - protein, 39 aa, Artificial Sequence; identical to SEQ ID NO: 394
  Synthetic peptide
  MISC_FEATURE (2)..(2): Xaa stands for Aib
  MISC_FEATURE (12)..(12): Xaa stands for Lys(Eda-PEG(2)-)
  MISC_FEATURE (26)..(26): Xaa stands for Iva

SEQ ID NO: 416 - protein, 39 aa, Artificial Sequence; identical to SEQ ID NO: 398
  Synthetic peptide
  MISC_FEATURE (2)..(2): Xaa stands for Aib
  MISC_FEATURE (17)..(17): Xaa stands for Lys(Eda-GGGGG-)
  MISC_FEATURE (26)..(26): Xaa stands for Iva

SEQ ID NO: 417 - protein, 39 aa, Artificial Sequence; identical to SEQ ID NO: 398
  Synthetic peptide
  MISC_FEATURE (2)..(2): Xaa stands for Aib
  MISC_FEATURE (17)..(17): Xaa stands for Lys(Eda-PEG(2)-)
  MISC_FEATURE (26)..(26): Xaa stands for Iva

SEQ ID NO: 418 - protein, 39 aa, Artificial Sequence; identical to SEQ ID NO: 394
  Synthetic peptide
  MISC_FEATURE (2)..(2): Xaa stands for Aib
  MISC_FEATURE (12)..(12): Xaa stands for Lys(Eda-GGGGG-)
  MISC_FEATURE (26)..(26): Xaa stands for Iva

SEQ ID NO: 419 - protein, 39 aa, Artificial Sequence; identical to SEQ ID NO: 394
  Synthetic peptide
  MISC_FEATURE (2)..(2): Xaa stands for Aib
  MISC_FEATURE (12)..(12): Xaa stands for Lys(Eda-PEG(2)-)
  MISC_FEATURE (26)..(26): Xaa stands for Iva

SEQ ID NO: 420 - protein, 39 aa, Artificial Sequence; identical to SEQ ID NO: 398
  Synthetic peptide
  MISC_FEATURE (2)..(2): Xaa stands for Aib
  MISC_FEATURE (17)..(17): Xaa stands for Lys(Eda-GGGGG-)
  MISC_FEATURE (26)..(26): Xaa stands for Iva

SEQ ID NO: 421 - protein, 39 aa, Artificial Sequence; identical to SEQ ID NO: 398
  Synthetic peptide
  MISC_FEATURE (2)..(2): Xaa stands for Aib
  MISC_FEATURE (17)..(17): Xaa stands for Lys(Eda-PEG(2)-)
  MISC_FEATURE (26)..(26): Xaa stands for Iva

SEQ ID NO: 422 - protein, 39 aa, Artificial Sequence; identical to SEQ ID NO: 242
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 423 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 424 - protein, 30 aa, Artificial Sequence; identical to SEQ ID NO: 275
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 425 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva

SEQ ID NO: 426 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 427 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 428 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 429 - protein, 29 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQ

SEQ ID NO: 430 - protein, 29 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQ

SEQ ID NO: 431 - protein, 29 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQ

SEQ ID NO: 432 - protein, 29 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQ

SEQ ID NO: 433 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 434 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Dda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 435 - protein, 30 aa, Artificial Sequence; identical to SEQ ID NO: 275
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-GGGGG-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 436 - protein, 30 aa, Artificial Sequence; identical to SEQ ID NO: 275
  Synthetic peptide
  MISC_FEATURE (2)..(2): Xaa stands for Aib
  MISC_FEATURE (6)..(6): Xaa stands for Iva
  MISC_FEATURE (12)..(12): Xaa stands for Lys(Eda-PEG(2)-)
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 437 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 438 - protein, 30 aa, Artificial Sequence; identical to SEQ ID NO: 381
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 439 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGG-)
  MISC_FEATURE (20)..(20): Xaa stands for Aib
  MISC_FEATURE (26)..(26): Xaa stands for Iva

SEQ ID NO: 440 - protein, 30 aa, Artificial Sequence; identical to SEQ ID NO: 278
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-PEG(2)-)
  MISC_FEATURE (20)..(20): Xaa stands for Aib
  MISC_FEATURE (26)..(26): Xaa stands for Iva

SEQ ID NO: 441 - protein, 30 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (30)..(30): Xaa stands for Lys(Eda-GGGGG-)
YXEGTXISDYSIXLDRXAQXNFVNWXLAQX

SEQ ID NO: 442 - protein, 30 aa, Artificial Sequence; identical to SEQ ID NO: 441
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (30)..(30): Xaa stands for Lys(Eda-PEG(2)-)

SEQ ID NO: 443 - protein, 30 aa, Artificial Sequence; identical to SEQ ID NO: 441
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (30)..(30): Xaa stands for Lys(Eda-GGGGG-)

SEQ ID NO: 444 - protein, 30 aa, Artificial Sequence; identical to SEQ ID NO: 441
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
  MISC_FEATURE (30)..(30): Xaa stands for Lys(Eda-PEG(2)-)

SEQ ID NO: 445 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 446 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 447 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Eda-GGGGGG-)
  MISC_FEATURE (20)..(20): Xaa stands for Aib
  MISC_FEATURE (26)..(26): Xaa stands for Iva

SEQ ID NO: 448 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 449 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 450 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 451 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 452 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 453 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Dda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 454 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 455 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Dda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 456 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 457 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Dda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 458 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Heda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 459 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Teda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 460 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Doda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 461 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Trda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 462 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Trda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 463 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Trda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 464 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Teda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 465 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Teda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 466 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Peda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 467 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Peda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 468 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Peda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 469 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Heda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 470 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Heda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 471 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Oda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 472 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 473 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Doda-GGGGG-) .
  MISC_FEATURE (20)..(20): Xaa stands for Aib
  MISC_FEATURE (26)..(26): Xaa stands for Iva

SEQ ID NO: 474 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Teda-GGGGG-)
  MISC_FEATURE (20)..(20): Xaa stands for Aib
  MISC_FEATURE (26)..(26): Xaa stands for Iva

SEQ ID NO: 475 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Heda-GGGGG-)
  MISC_FEATURE (20)..(20): Xaa stands for Aib
  MISC_FEATURE (26)..(26): Xaa stands for Iva

SEQ ID NO: 476 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(Hepda-GGGGG-)
  MISC_FEATURE (20)..(20): Xaa stands for Aib
  MISC_FEATURE (26)..(26): Xaa stands for Iva

SEQ ID NO: 477 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hepda-GGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 478 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hepda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 479 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hepda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 480 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(Hda-G9-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 481 - protein, 22 aa, Artificial Sequence
  Synthetic peptide
  MISC_FEATURE (3)..(3): Xaa stands for Aib
  MISC_FEATURE (9)..(9): Xaa stands for Iva
AQXNFVNWXLAQRPSSGAPPPS

SEQ ID NO: 482 - protein, 30 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXKDRXAQXNFVNWXLAQR

SEQ ID NO: 483 - protein, 39 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXKDRXAQXNFVNWXLAQRPSSGAPPPS

SEQ ID NO: 484 - protein, 40 aa, Artificial Sequence
  Synthetic peptide
  MISC_FEATURE (2)..(2): Xaa stands for Aib
  MISC_FEATURE (14)..(14): Xaa stands for K(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTFISDYSIAXDRXHQXNFVNWXLAQRPSSGAPPPSR

SEQ ID NO: 485 - protein, 40 aa, Artificial Sequence; identical to SEQ ID NO: 484
  Synthetic peptide
  MISC_FEATURE (2)..(2): Xaa stands for Aib
  MISC_FEATURE (14)..(14): Xaa stands for K(Teda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 486 - protein, 40 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXAQXNFVNWXLAQRPSSGAPPPSR

SEQ ID NO: 487 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Teda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 488 - protein, 39 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Eda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXHQXNFVNWXLAQRPSSGAPPPS

SEQ ID NO: 489 - protein, 39 aa, Artificial Sequence; identical to SEQ ID NO: 488
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Teda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 490 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Heda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 491 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Heda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 492 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 493 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 494 - protein, 40 aa, Artificial Sequence; identical to SEQ ID NO: 484
  Synthetic peptide
  MISC_FEATURE (2)..(2): Xaa stands for Aib
  MISC_FEATURE (14)..(14): Xaa stands for K(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 495 - protein, 40 aa, Artificial Sequence; identical to SEQ ID NO: 484
  Synthetic peptide
  MISC_FEATURE (2)..(2): Xaa stands for Aib
  MISC_FEATURE (14)..(14): Xaa stands for K(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 496 - protein, 39 aa, Artificial Sequence; identical to SEQ ID NO: 488
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 497 - protein, 39 aa, Artificial Sequence; identical to SEQ ID NO: 488
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 498 - protein, 40 aa, Artificial Sequence; identical to SEQ ID NO: 123
  Synthetic peptide
  MISC_FEATURE (2)..(2): Xaa stands for Aib
  MISC_FEATURE (17)..(17): Xaa stands for K(Oda-GGGGG-)
  MISC_FEATURE (20)..(20): Xaa stands for Aib
  MISC_FEATURE (26)..(26): Xaa stands for Iva

SEQ ID NO: 499 - protein, 40 aa, Artificial Sequence; identical to SEQ ID NO: 123
  Synthetic peptide
  MISC_FEATURE (2)..(2): Xaa stands for Aib
  MISC_FEATURE (17)..(17): Xaa stands for K(Oda-GGGGGG-)
  MISC_FEATURE (20)..(20): Xaa stands for Aib
  MISC_FEATURE (26)..(26): Xaa stands for Iva

SEQ ID NO: 500 - protein, 40 aa, Artificial Sequence; identical to SEQ ID NO: 123
  Synthetic peptide
  MISC_FEATURE (2)..(2): Xaa stands for Aib
  MISC_FEATURE (17)..(17): Xaa stands for K(Eda-GGGGG-)
  MISC_FEATURE (20)..(20): Xaa stands for Aib
  MISC_FEATURE (26)..(26): Xaa stands for Iva

SEQ ID NO: 501 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGG-)
  MISC_FEATURE (20)..(20): Xaa stands for Aib
  MISC_FEATURE (26)..(26): Xaa stands for Iva

SEQ ID NO: 502 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGGG-)
  MISC_FEATURE (20)..(20): Xaa stands for Aib
  MISC_FEATURE (26)..(26): Xaa stands for Iva

SEQ ID NO: 503 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Eda-GGGGG-)
  MISC_FEATURE (20)..(20): Xaa stands for Aib
  MISC_FEATURE (26)..(26): Xaa stands for Iva

SEQ ID NO: 504 - protein, 39 aa, Artificial Sequence; identical to SEQ ID NO: 256
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGG-)
  MISC_FEATURE (20)..(20): Xaa stands for Aib
  MISC_FEATURE (26)..(26): Xaa stands for Iva

SEQ ID NO: 505 - protein, 39 aa, Artificial Sequence; identical to SEQ ID NO: 256
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGGG-)
  MISC_FEATURE (20)..(20): Xaa stands for Aib
  MISC_FEATURE (26)..(26): Xaa stands for Iva

SEQ ID NO: 506 - protein, 39 aa, Artificial Sequence; identical to SEQ ID NO: 256
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Eda-GGGGG-)
  MISC_FEATURE (20)..(20): Xaa stands for Aib
  MISC_FEATURE (26)..(26): Xaa stands for Iva

SEQ ID NO: 507 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGGG-)
  MISC_FEATURE (20)..(20): Xaa stands for Aib
  MISC_FEATURE (26)..(26): Xaa stands for Iva

SEQ ID NO: 508 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGGG-)
  MISC_FEATURE (20)..(20): Xaa stands for Aib
  MISC_FEATURE (26)..(26): Xaa stands for Iva

SEQ ID NO: 509 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Oda-GGGGGG-)
  MISC_FEATURE (20)..(20): Xaa stands for Aib
  MISC_FEATURE (26)..(26): Xaa stands for Iva

SEQ ID NO: 510 - protein, 40 aa, Artificial Sequence; identical to SEQ ID NO: 123
  Synthetic peptide
  MISC_FEATURE (2)..(2): Xaa stands for Aib
  MISC_FEATURE (17)..(17): Xaa stands for K(Hepda-GGGGG-)
  MISC_FEATURE (20)..(20): Xaa stands for Aib
  MISC_FEATURE (26)..(26): Xaa stands for Iva

SEQ ID NO: 511 - protein, 40 aa, Artificial Sequence; identical to SEQ ID NO: 123
  Synthetic peptide
  MISC_FEATURE (2)..(2): Xaa stands for Aib
  MISC_FEATURE (17)..(17): Xaa stands for K(Heda-GGGGGG-)
  MISC_FEATURE (20)..(20): Xaa stands for Aib
  MISC_FEATURE (26)..(26): Xaa stands for Iva

SEQ ID NO: 512 - protein, 40 aa, Artificial Sequence; identical to SEQ ID NO: 123
  Synthetic peptide
  MISC_FEATURE (2)..(2): Xaa stands for Aib
  MISC_FEATURE (17)..(17): Xaa stands for K(Hepda-GGGGGG-)
  MISC_FEATURE (20)..(20): Xaa stands for Aib
  MISC_FEATURE (26)..(26): Xaa stands for Iva

SEQ ID NO: 513 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGG-)
  MISC_FEATURE (20)..(20): Xaa stands for Aib
  MISC_FEATURE (26)..(26): Xaa stands for Iva

SEQ ID NO: 514 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGGG-)
  MISC_FEATURE (20)..(20): Xaa stands for Aib
  MISC_FEATURE (26)..(26): Xaa stands for Iva

SEQ ID NO: 515 - protein, 39 aa, Artificial Sequence; identical to SEQ ID NO: 256
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGG-)
  MISC_FEATURE (20)..(20): Xaa stands for Aib
  MISC_FEATURE (26)..(26): Xaa stands for Iva

SEQ ID NO: 516 - protein, 39 aa, Artificial Sequence; identical to SEQ ID NO: 256
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGGG-)
  MISC_FEATURE (20)..(20): Xaa stands for Aib
  MISC_FEATURE (26)..(26): Xaa stands for Iva

SEQ ID NO: 517 - protein, 39 aa, Artificial Sequence; identical to SEQ ID NO: 256
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Hepda-GGGGGG-)
  MISC_FEATURE (20)..(20): Xaa stands for Aib
  MISC_FEATURE (26)..(26): Xaa stands for Iva

SEQ ID NO: 518 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Hepda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 519 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Hepda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 520 - protein, 39 aa, Artificial Sequence; identical to SEQ ID NO: 488
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Heda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 521 - protein, 39 aa, Artificial Sequence; identical to SEQ ID NO: 488
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Hepda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 522 - protein, 39 aa, Artificial Sequence; identical to SEQ ID NO: 488
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Heda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 523 - protein, 39 aa, Artificial Sequence; identical to SEQ ID NO: 488
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Hepda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 524 - protein, 40 aa, Artificial Sequence; identical to SEQ ID NO: 484
  Synthetic peptide
  MISC_FEATURE (2)..(2): Xaa stands for Aib
  MISC_FEATURE (14)..(14): Xaa stands for K(Heda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 525 - protein, 40 aa, Artificial Sequence; identical to SEQ ID NO: 484
  Synthetic peptide
  MISC_FEATURE (2)..(2): Xaa stands for Aib
  MISC_FEATURE (14)..(14): Xaa stands for K(Hepda-GGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 526 - protein, 40 aa, Artificial Sequence; identical to SEQ ID NO: 484
  Synthetic peptide
  MISC_FEATURE (2)..(2): Xaa stands for Aib
  MISC_FEATURE (14)..(14): Xaa stands for K(Heda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 527 - protein, 40 aa, Artificial Sequence; identical to SEQ ID NO: 484
  Synthetic peptide
  MISC_FEATURE (2)..(2): Xaa stands for Aib
  MISC_FEATURE (14)..(14): Xaa stands for K(Hepda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 528 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGG-)
  MISC_FEATURE (20)..(20): Xaa stands for Aib
  MISC_FEATURE (26)..(26): Xaa stands for Iva

SEQ ID NO: 529 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGGG-)
  MISC_FEATURE (20)..(20): Xaa stands for Aib
  MISC_FEATURE (26)..(26): Xaa stands for Iva

SEQ ID NO: 530 - protein, 39 aa, Artificial Sequence; identical to SEQ ID NO: 256
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(Heda-GGGGG-)
  MISC_FEATURE (20)..(20): Xaa stands for Aib
  MISC_FEATURE (26)..(26): Xaa stands for Iva

SEQ ID NO: 531 - protein, 40 aa, Artificial Sequence; identical to SEQ ID NO: 123
  Synthetic peptide
  MISC_FEATURE (2)..(2): Xaa stands for Aib
  MISC_FEATURE (17)..(17): Xaa stands for K(Heda-GGGGG-)
  MISC_FEATURE (20)..(20): Xaa stands for Aib
  MISC_FEATURE (26)..(26): Xaa stands for Iva

SEQ ID NO: 532 - protein, 39 aa, Artificial Sequence; identical to SEQ ID NO: 305
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Oda-PEG(2)-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 533 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 534 - protein, 39 aa, Artificial Sequence; identical to SEQ ID NO: 488
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 535 - protein, 40 aa, Artificial Sequence; identical to SEQ ID NO: 484
  Synthetic peptide
  MISC_FEATURE (2)..(2): Xaa stands for Aib
  MISC_FEATURE (14)..(14): Xaa stands for K(Eda-GGGGGG-)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 536 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Heda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 537 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGGG-Heda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 538 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Hepda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 539 - protein, 40 aa, Artificial Sequence; identical to SEQ ID NO: 486
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Oda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 540 - protein, 40 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Heda)
  MISC_FEATURE (17)..(17): Xaa stands for Aib
  MISC_FEATURE (20)..(20): Xaa stands for Aib
  MISC_FEATURE (26)..(26): Xaa stands for Iva
YXEGTXISDYSIXXDRXHQXNFVNWXLAQRPSSGAPPPSR

SEQ ID NO: 541 - protein, 40 aa, Artificial Sequence; identical to SEQ ID NO: 540
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGGG-Heda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 542 - protein, 40 aa, Artificial Sequence; identical to SEQ ID NO: 540
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Hepda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 543 - protein, 40 aa, Artificial Sequence; identical to SEQ ID NO: 540
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Oda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 544 - protein, 40 aa, Artificial Sequence; identical to SEQ ID NO: 540
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for K(-GGGGG-Eda)
  MISC_FEATURE (17)..(17): Xaa stands for Aib
  MISC_FEATURE (20)..(20): Xaa stands for Aib
  MISC_FEATURE (26)..(26): Xaa stands for Iva

SEQ ID NO: 545 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Heda)
  MISC_FEATURE (20)..(20): Xaa stands for Aib
  MISC_FEATURE (26)..(26): Xaa stands for Iva

SEQ ID NO: 546 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Hepda)
  MISC_FEATURE (20)..(20): Xaa stands for Aib
  MISC_FEATURE (26)..(26): Xaa stands for Iva

SEQ ID NO: 547 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Eda)
  MISC_FEATURE (20)..(20): Xaa stands for Aib
  MISC_FEATURE (26)..(26): Xaa stands for Iva

SEQ ID NO: 548 - protein, 39 aa, Artificial Sequence; identical to SEQ ID NO: 239
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Eda)
  MISC_FEATURE (20)..(20): Xaa stands for Aib
  MISC_FEATURE (26)..(26): Xaa stands for Iva

SEQ ID NO: 549 - protein, 39 aa, Artificial Sequence; identical to SEQ ID NO: 256
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Heda)
  MISC_FEATURE (20)..(20): Xaa stands for Aib
  MISC_FEATURE (26)..(26): Xaa stands for Iva

SEQ ID NO: 550 - protein, 39 aa, Artificial Sequence; identical to SEQ ID NO: 256
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Eda)
  MISC_FEATURE (20)..(20): Xaa stands for Aib
  MISC_FEATURE (26)..(26): Xaa stands for Iva

SEQ ID NO: 551 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Heda)
  MISC_FEATURE (20)..(20): Xaa stands for Aib
  MISC_FEATURE (26)..(26): Xaa stands for Iva

SEQ ID NO: 552 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Heda)
  MISC_FEATURE (20)..(20): Xaa stands for Aib
  MISC_FEATURE (26)..(26): Xaa stands for Iva

SEQ ID NO: 553 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Hepda)
  MISC_FEATURE (20)..(20): Xaa stands for Aib
  MISC_FEATURE (26)..(26): Xaa stands for Iva

SEQ ID NO: 554 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Hepda)
  MISC_FEATURE (20)..(20): Xaa stands for Aib
  MISC_FEATURE (26)..(26): Xaa stands for Iva

SEQ ID NO: 555 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Oda)
  MISC_FEATURE (20)..(20): Xaa stands for Aib
  MISC_FEATURE (26)..(26): Xaa stands for Iva

SEQ ID NO: 556 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Oda)
  MISC_FEATURE (20)..(20): Xaa stands for Aib
  MISC_FEATURE (26)..(26): Xaa stands for Iva

SEQ ID NO: 557 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Eda)
  MISC_FEATURE (20)..(20): Xaa stands for Aib
  MISC_FEATURE (26)..(26): Xaa stands for Iva

SEQ ID NO: 558 - protein, 40 aa, Artificial Sequence; identical to SEQ ID NO: 93
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Eda)
  MISC_FEATURE (20)..(20): Xaa stands for Aib
  MISC_FEATURE (26)..(26): Xaa stands for Iva

SEQ ID NO: 559 - protein, 40 aa, Artificial Sequence; identical to SEQ ID NO: 125
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Heda)
  MISC_FEATURE (20)..(20): Xaa stands for Aib
  MISC_FEATURE (26)..(26): Xaa stands for Iva

SEQ ID NO: 560 - protein, 40 aa, Artificial Sequence; identical to SEQ ID NO: 125
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Heda)
  MISC_FEATURE (20)..(20): Xaa stands for Aib
  MISC_FEATURE (26)..(26): Xaa stands for Iva

SEQ ID NO: 561 - protein, 40 aa, Artificial Sequence; identical to SEQ ID NO: 125
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Hepda)
  MISC_FEATURE (20)..(20): Xaa stands for Aib
  MISC_FEATURE (26)..(26): Xaa stands for Iva

SEQ ID NO: 562 - protein, 40 aa, Artificial Sequence; identical to SEQ ID NO: 125
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Hepda)
  MISC_FEATURE (20)..(20): Xaa stands for Aib
  MISC_FEATURE (26)..(26): Xaa stands for Iva

SEQ ID NO: 563 - protein, 40 aa, Artificial Sequence; identical to SEQ ID NO: 125
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Oda)
  MISC_FEATURE (20)..(20): Xaa stands for Aib
  MISC_FEATURE (26)..(26): Xaa stands for Iva

SEQ ID NO: 564 - protein, 40 aa, Artificial Sequence; identical to SEQ ID NO: 125
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGG-Eda)
  MISC_FEATURE (20)..(20): Xaa stands for Aib
  MISC_FEATURE (26)..(26): Xaa stands for Iva

SEQ ID NO: 565 - protein, 40 aa, Artificial Sequence; identical to SEQ ID NO: 125
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for K(-GGGGGG-Eda)
  MISC_FEATURE (20)..(20): Xaa stands for Aib
  MISC_FEATURE (26)..(26): Xaa stands for Iva

SEQ ID NO: 566 - protein, 40 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Leu. Provided that any one amino acid selected from A14 and A17 represent Lys(R).
  MISC_FEATURE (17)..(17): Xaa stands for Aib
  MISC_FEATURE (18)..(18): Xaa stands for Ala or His
  MISC_FEATURE (20)..(20): Xaa stands for Aib
  MISC_FEATURE (26)..(26): Xaa stands for Iva
  MISC_FEATURE (40)..(40): Xaa stands for Arg or a deletion
YXEGTXISDYSIXXDRXXQXNFVNWXLAQRPSSGAPPPSX

SEQ ID NO: 567 - protein, 40 aa, Artificial Sequence
  Synthetic peptide
  MISC_FEATURE (2)..(2): Xaa stands for Aib
  MISC_FEATURE (6)..(6): Xaa stands for Iva, Phe, or Val
  MISC_FEATURE (7)..(7): Xaa stands for Ile or Val
  MISC_FEATURE (9)..(9): Xaa stands for Asp or Leu
  MISC_FEATURE (13)..(13): Xaa stands for Aib or Ala
  MISC_FEATURE (16)..(16): Xaa stands for Arg or Lys
  MISC_FEATURE (17)..(17): Xaa stands for Aib, Gln, or Ile
  MISC_FEATURE (18)..(18): Xaa stands for Ala or His
  MISC_FEATURE (20)..(20): Xaa stands for Aib, or Gln
  MISC_FEATURE (21)..(21): Xaa stands for Asn, Glu, or Asp
  MISC_FEATURE (24)..(24): Xaa stands for Arg, Asn, or Lys
  MISC_FEATURE (26)..(26): Xaa stands for Iva or Leu
  MISC_FEATURE (28)..(28): Xaa stands for Ala, Arg, or Lys
  MISC_FEATURE (29)..(29): Xaa stands for Gln or Gly
  MISC_FEATURE (30)..(30): Xaa stands for Arg, or Gly
  MISC_FEATURE (40)..(40): Xaa stands for Arg, Lys, or a deletion
YXEGTXXSXYSIXLDXXXQXXFVXWXLXXXPSSGAPPPSX

SEQ ID NO: 568 - protein, 40 aa, Artificial Sequence; identical to SEQ ID NO: 566
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (14)..(14): Xaa stands for Lys(R), wherein R represents X-L-,  -L- represents -GGGGG- or -GGGGGG- and X represents Heda, Hepda, Oda or Eda
  MISC_FEATURE (17)..(17): Xaa stands for Aib
  MISC_FEATURE (18)..(18): Xaa stands for Ala or His
  MISC_FEATURE (20)..(20): Xaa stands for Aib
  MISC_FEATURE (26)..(26): Xaa stands for Iva
  MISC_FEATURE (40)..(40): Xaa stands for Arg or a deletion

SEQ ID NO: 569 - protein, 40 aa, Artificial Sequence
  Synthetic peptide
  MISC_FEATURE (2)..(2): Xaa stands for Aib
  MISC_FEATURE (6)..(6): Xaa stands for Iva
  MISC_FEATURE (13)..(13): Xaa stands for Aib
  MISC_FEATURE (17)..(17): Xaa stands for Lys(R), wherein R represents -L-X, -L- represents -GGGGG- or -GGGGGG- and X represents Heda, Hepda, Oda or Eda.
  MISC_FEATURE (17)..(17): Xaa stands for Lys(R), wherein R represents X-L-, -L- represents -GGGGG- or -GGGGGG- and X represents Heda, Hepda, Oda or Eda.
  MISC_FEATURE (18)..(18): Xaa stands for Ala or His
  MISC_FEATURE (20)..(20): Xaa stands for Aib
  MISC_FEATURE (26)..(26): Xaa stands for Iva
  MISC_FEATURE (40)..(40): Xaa stands for Arg or a deletion
YXEGTXISDYSIXLDRXXQXNFVNWXLAQRPSSGAPPPSX

The invention claimed is:

1. A peptide represented by formula:
H-Tyr-Aib-Glu-Gly-Thr-Val-Val-Ser-Leu-Tyr-Ser-Ile-Aib-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys-NH$_2$ (SEQ ID NO: 12), or a pharmaceutically acceptable salt thereof; or
H-Tyr-Aib-Glu-Gly-Thr-Val-Val-Ser-Leu-Tyr-Ser-Ile-Aib-Leu-Asp-Arg-Gln-Ala-Gln-Aib-Glu-Phe-Val-Arg-Trp-Leu-Leu-Arg-Gly-Gly-Pro-Ser-Ser-Gly-Ala-Pro-Pro-Pro-Ser-Arg-NH$_2$ (SEQ ID NO: 36), or a pharmaceutically acceptable salt thereof; or
Me-Tyr-Aib-Glu-Gly-Thr-Phe-Ile-Ser-Asp-Tyr-Ser-Ile-Ala-Leu-Asp-Arg-Ile-Ala-Gln-Gln-Asp-Phe-Val-Asn-Trp-Leu-Leu-Ala-Arg-Pro-Ser-Ser-Gly-Ala-Pro-Pro-Pro-Ser-Arg-NH$_2$ (SEQ ID NO: 65), or a pharmaceutically acceptable salt thereof; or
Me-Tyr-Aib-Glu-Gly-Thr-Iva-Ile-Ser-Asp-Tyr-Ser-Ile-Ala-Leu-Asp-Arg-Aib-Ala-Gln-Aib-Asn-Phe-Val-Asn-Trp-Leu-Leu-Ala-Gln-Arg-Pro-Ser-Ser-Gly-Ala-Pro-Pro-Pro-Ser-Arg-NH$_2$ (SEQ ID NO: 110), or a pharmaceutically acceptable salt thereof; or
Me-Tyr-Aib-Glu-Gly-Thr-Iva-Ile-Ser-Asp-Tyr-Ser-Ile-Aib-Leu-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$ (SEQ ID NO: 119), or a pharmaceutically acceptable salt thereof; or
Me-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$ (SEQ ID NO: 123), or a pharmaceutically acceptable salt thereof; or
Me-Tyr-Aib-Glu-Gly-Thr-Iva-Ile-Ser-Asp-Tyr-Ser-Ile-Aib-Lys(Eda-GGGGG-)-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$(SEQ ID NO: 354), or a pharmaceutically acceptable salt thereof; or
Me-Tyr-Aib-Glu-Gly-Thr-Iva-Ile-Ser-Asp-Tyr-Ser-Ile-Aib-Leu-Asp-Arg-Lys(Oda-GGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$(SEQ ID NO: 362), or a pharmaceutically acceptable salt thereof.

2. A medicament comprising the peptide according to claim 1, or a pharmaceutically acceptable salt thereof.

3. The medicament according to claim 2, which is an activator of a GIP receptor.

4. The medicament according to claim 2, which is a suppressant for vomiting or nausea.

5. A method for suppressing vomiting or nausea in a mammal, comprising administering an effective amount of the peptide of claim 1 or a pharmaceutically acceptable salt thereof to the mammal.

6. A method for activating a GIP receptor in a mammal, comprising administering an effective amount of the peptide of claim 1 or a pharmaceutically acceptable salt thereof to the mammal.

7. The peptide of claim 1 or a pharmaceutically acceptable salt thereof for use in suppressing vomiting or nausea.

8. The method according to claim 5, wherein the vomiting or the nausea is caused by one or more conditions or causes selected from the following (1) to (6):
   (1) diseases such as gastroparesis, gastrointestinal hypomotility, peritonitis, abdominal tumor, constipation, gastrointestinal obstruction, cyclic vomiting syndrome, chronic unexplained nausea and vomiting, acute and chronic pancreatitis, hyperkalemia, cerebral edema, intracranial lesion, metabolic disorder, gastritis caused by an infection, hyperemesis gravidarium, postoperative disease, myocardial infarction, migraine, intracranial hypertension, cannabis hyperemesis syndrome, and intracranial hypotension;
   (2) drugs such as (i) alkylating agents, cytotoxic antibiotics, antimetabolic agents, vinca alkaloids, other chemotherapeutic agents; (ii) opioid analgesics; (iii) dopamine receptor D1D2 agonists; and (iv) cannabis and cannabinoid products;
   (3) radiation sickness or radiation therapy used to treat cancers;

(4) a poisonous substance or a toxin;
(5) pregnancy; and
(6) a vestibular disorder.

9. A peptide represented by formula:
H-Tyr-Aib-Glu-Gly-Thr-Val-Val-Ser-Leu-Tyr-Ser-Ile-Aib-Leu-Asp-Lys-Gln-Ala-Gln-Aib-Glu-Phe-Val-Lys-Trp-Leu-Leu-Lys-Gly-Gly-Pro-Ser-Ser-Gly-Ala-Pro-Pro-Pro-Ser-Lys-NH$_2$ (SEQ ID NO: 12), or a pharmaceutically acceptable salt thereof.

10. A peptide represented by formula:
H-Tyr-Aib-Glu-Gly-Thr-Val-Val-Ser-Leu-Tyr-Ser-Ile-Aib-Leu-Asp-Arg-Gln-Ala-Gln-Aib-Glu-Phe-Val-Arg-Trp-Leu-Leu-Arg-Gly-Gly-Pro-Ser-Ser-Gly-Ala-Pro-Pro-Pro-Ser-Arg-NH$_2$ (SEQ ID NO: 36), or a pharmaceutically acceptable salt thereof.

11. A peptide represented by formula:
Me-Tyr-Aib-Glu-Gly-Thr-Phe-Ile-Ser-Asp-Tyr-Ser-Ile-Ala-Leu-Asp-Arg-Ile-Ala-Gln-Gln-Asp-Phe-Val-Asn-Trp-Leu-Leu-Ala-Gln-Arg-Pro-Ser-Ser-Gly-Ala-Pro-Pro-Pro-Ser-Arg-NH$_2$ (SEQ ID NO: 65), or a pharmaceutically acceptable salt thereof.

12. A peptide represented by formula:
Me-Tyr-Aib-Glu-Gly-Thr-Iva-Ile-Ser-Asp-Tyr-Ser-Ile-Ala-Leu-Asp-Arg-Aib-Ala-Gln-Aib-Asn-Phe-Val-Asn-Trp-Leu-Leu-Ala-Gln-Arg-Pro-Ser-Ser-Gly-Ala-Pro-Pro-Pro-Ser-Arg-NH$_2$ (SEQ ID NO: 110), or a pharmaceutically acceptable salt thereof.

13. A peptide represented by formula:
Me-Tyr-Aib-Glu-Gly-Thr-Iva-Ile-Ser-Asp-Tyr-Ser-Ile-Aib-Leu-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$ (SEQ ID NO: 119), or a pharmaceutically acceptable salt thereof.

14. A peptide represented by formula:
Me-Tyr-Aib-Glu-Gly-Thr-Phe-Ile-Ser-Asp-Tyr-Ser-Ile-Ala-Leu-Asp-Arg-Aib-His-Gln-Aib-Asn-Phe-Val-Asn-Trp-Iva-Leu-Ala-Gln-Arg-Pro-Ser-Ser-Gly-Ala-Pro-Pro-Pro-Ser-Arg-NH$_2$ (SEQ ID NO: 123), or a pharmaceutically acceptable salt thereof.

15. A peptide represented by formula:
Me-Tyr-Aib-Glu-Gly-Thr-Iva-Ile-Ser-Asp-Tyr-Ser-Ile-Aib-Lys(Eda-GGGGG-)-Asp-Arg-Aib-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$ (SEQ ID NO: 354), or a pharmaceutically acceptable salt thereof.

16. A peptide represented by formula:
Me-Tyr-Aib-Glu-Gly-Thr-Iva-Ile-Ser-Asp-Tyr-Ser-Ile-Aib-Leu-Asp-Arg-Lys(Oda-GGGGG-)-Ala-Gln-Aib-Asn-Phe-Val-Asn-Trp-Iva-Leu-Ala-Gln-Arg-Pro-Ser-Ser-Gly-Ala-Pro-Pro-Pro-Ser-NH$_2$ (SEQ ID NO: 362), or a pharmaceutically acceptable salt thereof.

17. A method for suppressing vomiting or nausea in a mammal, comprising administering an effective amount of the peptide of claim 9 or a pharmaceutically acceptable salt thereof to the mammal.

18. A method for suppressing vomiting or nausea in a mammal, comprising administering an effective amount of the peptide of claim 10 or a pharmaceutically acceptable salt thereof to the mammal.

19. A method for suppressing vomiting or nausea in a mammal, comprising administering an effective amount of the peptide of claim 11 or a pharmaceutically acceptable salt thereof to the mammal.

20. A method for suppressing vomiting or nausea in a mammal, comprising administering an effective amount of the peptide of claim 12 or a pharmaceutically acceptable salt thereof to the mammal.

21. A method for suppressing vomiting or nausea in a mammal, comprising administering an effective amount of the peptide of claim 13 or a pharmaceutically acceptable salt thereof to the mammal.

22. A method for suppressing vomiting or nausea in a mammal, comprising administering an effective amount of the peptide of claim 14 or a pharmaceutically acceptable salt thereof to the mammal.

23. A method for suppressing vomiting or nausea in a mammal, comprising administering an effective amount of the peptide of claim 15 or a pharmaceutically acceptable salt thereof to the mammal.

24. A method for suppressing vomiting or nausea in a mammal, comprising administering an effective amount of the peptide of claim 16 or a pharmaceutically acceptable salt thereof to the mammal.

25. A medicament comprising the peptide according to claim 9, or a pharmaceutically acceptable salt thereof.

26. A medicament comprising the peptide according to claim 10, or a pharmaceutically acceptable salt thereof.

27. A medicament comprising the peptide according to claim 11, or a pharmaceutically acceptable salt thereof.

28. A medicament comprising the peptide according to claim 12, or a pharmaceutically acceptable salt thereof.

29. A medicament comprising the peptide according to claim 13, or a pharmaceutically acceptable salt thereof.

30. A medicament comprising the peptide according to claim 14, or a pharmaceutically acceptable salt thereof.

31. A medicament comprising the peptide according to claim 15, or a pharmaceutically acceptable salt thereof.

32. A medicament comprising the peptide according to claim 16, or a pharmaceutically acceptable salt thereof.

33. The method according to claim 8, wherein the alkylating agent comprises cyclophosphamide, carmustine, lomustine, chlorambucil, streptozocin, dacarbazine, ifosfamide, temozolomide, busulfan, bendamustine, or melphalan.

34. The method according to claim 8, wherein the cytotoxic antibiotic comprises dactinomycin, doxorubicin, mitomycin-C, bleomycin, epirubicin, actinomycin D, amrubicin, idarubicin, daunorubicin, or pirarubicin.

35. The method according to claim 8, wherein the antimetabolic agent comprises cytarabine, methotrexate, 5-fluorouracil, enocitabine, or clofarabine.

36. The method according to claim 8, wherein the vinca alkaloid comprises etoposide, vinblastine, or vincristine.

37. The method according to claim 8, wherein the other chemotherapeutic agent comprises cisplatin, procarbazine, hydroxyurea, azacytidine, irinotecan, interferon α, interleukin-2, oxaliplatin, carboplatin, nedaplatin, or miriplatin.

38. The method according to claim 8, wherein the opioid analgesic comprises morphine.

39. The method according to claim 8, wherein the dopamine receptor D1D2 agonist comprises apomorphine.

40. The method according to claim 8, wherein the intracranial hypotension comprises altitude sickness.

41. The method according to claim 8, wherein the vestibular disorder comprises motion sickness or dizziness.

* * * * *